United States Patent 11,931,406 (FLAVIVIRUS VACCINE) - sequence listing, part 15

SEQ ID NO: 7678 - RNA, 9873 nt, Artificial Sequence
  derived and/or modified CDS sequence (wt) from DENV-3__FJ432741__SS-prME
acaucgcucugccucaugaugauguuaccagcaacacuugcuuuccaccugacuucacgcgauggagaaccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauugaucacagccaacccagugguggccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaauacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagaggugcacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacauggucaucccaaagagucuagcuggucccauuucacaacacaaccacaggccuggguaccacacccaaacggcaggaccuuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaguguucaaaaagcgaaaucuaaccauaauggaucuucauccugggucaggaaagacgcggaaauaccuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugaucgacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccugcucuugggacucaugaucuuauuaacagguggagcaaugcuuuuccugauaucagguaaagggauuggaaagacuucaauaggacucauuugcguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauuacuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacguaaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggaccuauggucugaacacauucaccaacauggaagcccaauuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7679 - RNA, 9873 nt, Artificial Sequence
  derived and/or modified CDS sequence (wt) from DENV-3__FJ562099__SS-prME
acaucgcucugccucaugaugauguuaccagcaacacuugcuuuccacuugacuucacgcgauggagagccgcgcaugaucguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaaggugcccuacccagggggaagcgauucuaccugaggagcaggaccagaacuacguguguaagcauacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggauaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucaugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacauguucaaacacaauuuucacgcugacuguugccuggagaacagccaccuugauucuggccggaguuucgcuuuugccacugugccagucuucgagcaugaggaaaacagauuggcucccaaugacuguagcagcuaugggaguuccacccuuaccacuuuuuaucuucagcuugaaggacacaccaaaaaggaggagcuggccacugaaugagggggugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcgucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagugugaaaaaagaucugauuucauacggaggaggauggagauugagcgcacaauggcaaaaaggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucguuagagaagcaaucaagagacguuugagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacaccccccggaacugcugaagccuuuccccagagcaacgcuccaauucaagaugaagaaagggauauuccggaacgcucauggaauucaggcaaugaauggauuaccgacuuuguuggaaagacggugugguuuguacccagcaucaaagccggaaaugacauagcaaacugccugcggaaaaaugggaaaaaggucauccaacuuaguagaaagacuuuugauacagaauaucaaaagaccaaacugaaugauugggacuucguggugacaacagacauuucagaaaugggagcuaacuuuaaagcagauagagugauugacccaagaagaugucucaagccgguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucuauuugaaccagagagggagaagucagccgcuauagacggugaauaccgccugaagggugaguccaggaagaccuucguggaacucaugaggaggggagaccucccaguuuggcuagcccacaaaguagccucagaagggaucaaauacacagacagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggcguuguuucuccaaccagcuauuuagauguagacuugcacccagcaucagccuggacauuguacgccguggccacaacaguaauaacaccaauguugagacauaccauagagaauuccacagcaaauguaucccuggcagccauagcuaaccaggcagugguccugauggguuuagacaaaggauggccaauaucgaaaauggaucuaggcguaccgcuacuggcacuaggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguugucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugugcaggacugaaaaaaguuacagaagugcgaggauacacaaaagguggcccaggacacgaagaaccaguacccauguccacauacggauggaauauagucaagcuaaugaguggaaaggacguguuuuaucuuccaccugaaaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguacuggcaacaucgucucuucagucaacaugguauccagauugcugcugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccucuaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguacaacgaccaacuccaaaaggcacgguaauggacaucauaucuagaaaagaccaaagaggcaguggacagguggggacuuauggucugaacacauuuaccaacauggaagcccaguuagucagacagauggaaggagaaggcguguugucgaaggcagaccucgagaacccccaucugcuagagaagaaaaucacacaaugguuggaaaccaaaggaguggagagauuaaaaagaauggccaucagcggagaugauuguguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguccccugcagaccccaggacgaacuaauaggaagggcgagaauuucucaaggagcaggauggagccuuaaagaaaccgcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7680 - RNA, 9873 nt, Artificial Sequence
  derived and/or modified CDS sequence (wt) from DENV-3__KF955457__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagccacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuucucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaagacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagcuaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagauaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggauaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauugaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7681 - RNA, 9873 nt, Artificial Sequence
  derived and/or modified CDS sequence (wt) from DENV-3__FJ562100__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacgguggaugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccaucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacguucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuacaguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7682 - RNA, 9873 nt, Artificial Sequence
  derived and/or modified CDS sequence (wt) from DENV-3__FJ547062__SS-prME
acaucgcucugccucaugaugauguuaccagcaacacuugcuuuccaccugacuucacgcgauggagagccgcgcaugauuguggggaagaaugaaagagggaaauccuugcuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaagcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccaucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuuuacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggccuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauaguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7683 - RNA, 9873 nt, Artificial Sequence
  derived and/or modified CDS sequence (wt) from DENV-3__FJ461322__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacguuggacauagagcuucagaagaccgaggccacccaacuggcgacccuaaggaaguuaugcauugagggaaaaauuaccaacauaacaacugacucaagguguccuacccagggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauacuuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggagagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcgugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuuuacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacauacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccaguuaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaaugcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuagcagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaggucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggugucguuucuccaaccagcuauuuagauguagacuugcacccagcaucagccuggacauuguacgcuguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuugggagaaaaguggaaaaagaaauuaaaucaguuaucccggaaagaguuugaucuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguuuuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauauuccauaccuagggaagagagaagaucaauggugcggaucacucauuggucucaccuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7684 - RNA, 9873 nt, Artificial Sequence
  derived and/or modified CDS sequence (wt) from DENV-3__KF955458__SS-prME
acaucgcucugccucaugaugauguuaccagcaacacuugcuuuccaucugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccaaggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaguaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugccugaauaccuuuguguugaagaaagaagucucugaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagaggugaacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaagaaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauaccugccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaccugaccauaauggaucuucauccugggucaggaaagacgcggaaauaccuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugacacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuugaugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacacuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacggcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaggugcgaggauacacaaaagguggcccaggacacgaagaaccaguacccauguccacauacggauggaaccuagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagaugggagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaaccccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7685 - RNA, 9873 nt, Artificial Sequence
  derived and/or modified CDS sequence (wt) from DENV-3__FJ562102__SS-prME
acaucgcucugccucaugaugauguuaccagcaacacuugcuuuccaccugacuucacgcgauggagaaccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacauucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuugcguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucguaauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccgcugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaauuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggugccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaagugagaagccuuauaggcgaugaagaauuucuggacuacaugccuucgaugaagagauucaggaaggaggaggagucagagggagccauuugguaa

SEQ ID NO: 7686 - RNA, 9873 nt, Artificial Sequence
  derived and/or modified CDS sequence (wt) from DENV-3__FJ410229__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagauauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuaugucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagagaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuugcguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggccaugggagcuguuuucacagaggagaaccaaugggauagcgcgagagcugcuguugaggacgaagaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaauuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7687 - RNA, 9873 nt, Artificial Sequence
  derived and/or modified CDS sequence (wt) from DENV-3__FJ461326__SS-prME
acaucgcucugccucaugaugauguuaccagcaacacuugcuuuccaccugacuucacgcgauggagaaccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaagcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaggaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguugggcuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaccugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauucaacuuaguagaaagacuuuugauacagaauaccaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucuuaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuugcguuauugcuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcaucaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagaaaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaauuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacagcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7688 - RNA, 9873 nt, Artificial Sequence
  derived and/or modified CDS sequence (wt) from DENV-3__FJ461329__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaagacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaagaaacacaugauugcagggguucucuucacguuugugcuccuucucucagggcaaauaacauggagagauauggcacacacacucauaaugauuggauccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugauaucccacuucaauggaucgcgucggcuauaguucuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagauaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagcuaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauugaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaucauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucacuaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuaugcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcaaugaagaauuucuggacuacaugccuucgaugaagagauucaggaaggaggaggagucagagggagccauuugguaa

SEQ ID NO: 7689 - RNA, 9873 nt, Artificial Sequence
  derived and/or modified CDS sequence (wt) from DENV-3__KF955459__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauuaaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucagcaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccuccuuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguccuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagauuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggguacauaucaacacguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacaucucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagauccccuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuugcguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauugaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaauuggucagacagauggaaggagaaggcguuuugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7690 - RNA, 9873 nt, Artificial Sequence
  derived and/or modified CDS sequence (wt) from DENV-3__FJ547066__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaauggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguccuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagguugagcgcacaauggcaaaagggagaggaggugcagguuauugccguagagccugggaagaacccaaaaaacuuccaaaccaugccgggcauuuuucagacaacaacgggggaaauaggagcaauugcacuagauuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuacauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuugcguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcagcuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgagggauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacaggcaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaauuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7691 - RNA, 9873 nt, Artificial Sequence
  derived and/or modified CDS sequence (wt) from DENV-3__KF955460__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuacacuacuaaugcuggucacuccauccaugacaaugagaugcgugggaguaggaaauagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacucagggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacuguuaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauacuuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggaaacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugccuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcgugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuuuacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuuugaagaggugaugagaggaaaauuugggaaaaaacacaugauugcagggguucucuucacguuugugcuccuucucucagggcaaauaacauggagagauauggcacauacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggauuaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucaucccgggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugauuuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaaaggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuagcagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggugucguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuugggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcagaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggaugaacugauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauauuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7692 - RNA, 9873 nt, Artificial Sequence
  derived and/or modified CDS sequence (wt) from DENV-3__FJ461334__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuagacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcgcaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaggaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggacccuggcacuugggaaaauuggagcuggacuuuaacuauugugaaggaacaacaguaguuaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauacagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcacacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagacccagccaguauagcggcuagaggauacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuugcguuauuguuuccaguggcauguuauggauggcugaugucccacuucaauggaucgcgucggcuauaauccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugcuauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucucggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguauuggauauccaaugguaccggcaacaucgucucuucagucaacaugguauccagauugcuacugaacagauuuacgaugacacauaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaaggugauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaauuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggauccccacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7693 - RNA, 9873 nt, Artificial Sequence
  derived and/or modified CDS sequence (wt) from DENV-3__FJ461337__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaagugguuguccuuggaucgcaagagggagcaaugcacacagcacugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucaaugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuuuaacuauugugaaggaacaacaguagucaucacagaagacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacagcgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugacauuggagaaucuucaccaaguccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaauaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7694 - RNA, 9873 nt, Artificial Sequence
  derived and/or modified CDS sequence (wt) from DENV-3__FJ461338__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuacaaaugcccccucguugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccaaggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaagaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaaucaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagccuuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccgaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaacgagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaacugacaucuagagaaaauuuguuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacucugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggaguuauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaauugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguggugggacuguauggcaauggagugguuacgaaaaaugguggcuacgucaguggaauagcgcaaacaaaugcagaaccagauggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuaguagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaauaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaauugagaccuagguggcuugaugcccgcacuuauucagaucccuuagcacuuaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuguuaacagguggagcaaugcuuuuccugauaucagguaaagggauuggaaagacuucaauaggacucauuuguguuauuguuuccagugguauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuagcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuugggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuagguuguggaagaggaggcuggucauauuauugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaucaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcagugccaguccauuggaucccuacaagcagaacgacauggucuauucacgcucaccaucaguggaugaccacagaagacaugcuaacugucuggaacaggguguggauagaggacaauccauggauggaagacaaaacuccaguuacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7695 - RNA, 9873 nt, Artificial Sequence
  derived and/or modified CDS sequence (wt) from DENV-3__FJ562103__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauagaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuacacuacuaaugcuggucacuccauccaugacaaugagaugcgugggaguaggaaauagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacucagggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacuguuaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauacuuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggaaacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugccuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcgugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccuccuucauaauagaugggccaaacacaccggaguguccaagugccucaagagcauggaaugugugggagguggaagauuacggguuuggagucuuuacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuuuaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuuugaagaggugaugagaggaaaauuugggaaaaaacacaugauugcagggguucucuucacguuugugcuccuucucucagggcaaauaacauggagagauauggcacauacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggauuaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucaucccgggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugauuuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaaaggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuagcagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggugucguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuugggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcagaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggaugaacugauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauauuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7696 - RNA, 9873 nt, Artificial Sequence
  derived and/or modified CDS sequence (wt) from DENV-3__FJ898456__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuucaggcacccaggguucacaauacuagcccuauuucuugcccauuacauaggcacuuccuugacccagaaagugguuauuuucauacuacuaaugcuggucaccccauccaugacaaugagaugugugggaguaggaaacagagacuuuguggaaggccuaucaggagcuacguggguugacguggugcucgagcacggugggugugugacuacuauggccaagaacaagcccacguuggauauagagcuccagaagaccgaggccacccaacuggcgacccuaaggaaacuauguauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacgugcgcgaaauuucaauguuuggaaucaauugagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaaacaagaaguaguaguccuuggaucgcaagagggagcaaugcacacagcacugacaggagccacagagauccaaaccucaggaggcacaaguauuuuugcggggcacuuaaaauguagacucaagauggacaaauuggaacucaaggggaugagcuaugcaaugugcuugaaugcuuucguguugaagaaagaagucucugaaacgcaacaugggacaauacucauuaagguugaguacaaaggggaagaugcaccuugcaagauuccuuucuccacggaggauggacaagggaaagcccacaauggcagacugaucacagcuaacccaauagugaccaagaaggaggagccugucaacauugaggcagaaccuccuuuuggggaaaguaauauaguaauuggaauuggagacaaagccuugaaaaucaacugguacaagaaaggaagcucgauugggaagauguucgaggccacugccagaggugcaaggcgcauggccaucuugggagacacagccugggacuuuggaucaguagguggcguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucaccaaugagguccacaccuggacagagcaauacaaguuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauugggaucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacaugccgacaugggcuauuggauagaaagccaaaagaauggaaguuggaagcuagaaaaggcaucccucauagagguaaagaccugcacauggccaaaaucacacacucuuuggagcaauggugugcuagagagugacaugaucaucccaaagagucuggcuggucccauuucgcaacacaacuacaggcccggauaccacacccaaaccgcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccucccuugcgauacaugggagaagacggcugcugguauggcauggaaaucagacccauuaaugagaaagaagagaacaugguaaagucuuuagucucagcagggaguggaaaggcggauaacuucacaaugggugucuuguguuuggcaaucuucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuagccauggcaacaacguuacaacugccagaggacauugaacaaauggcgaauggaauagcuuuagggcucauggcucuuaaauuaauaacacaauuugaaacauaccaacuauggacggcacuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaucccuaccacuuuuuauuuucaguuuaaaagacacgcucaaaaggagaagcuggccacugaaugagggggugauggcuguuggacuugugagcauccuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucauaccauguggcacgucacaagaggagcaguguugacacacaaugggaaaagacuggaaccaaacugggcuaaugugaaaaaagaucugauuucauacggaggaggauggaaauugagugcacaauggcaaaaaggagaggaggugcaaguuauugcuguagagccugggaagaacccaaagagcuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcgaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuuaauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuucgccgggaagacggugugguuugucccuagcauuaaagcuggaaaugacauagcaaacugcuugcggaaaaauggaaaaaaggucauucaacuuaguaggaagacuuuuaacacagaauaucaaaagacuaaacugaaugauugggacuuuguggugacaacagacauuucagaaaugggagccaauuucaaagcagacagagugaucgacccaagaagaugccucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcgaaaaugcuguuagacaacaucaacacaccagaagggauuauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagagcgcaauaaucaaauuuuagaggagaauauggauguggaaaucuggacaaaggaaggagagaagaaaaaauugagaccuagguggcuugaugcccgcacuuauucagauccauuagcgcucaaggaauuuaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuagcacuggguuguuauucacaagugaacccacuaacucucacagcggcaguacuccugcuagucacgcauuaugcuaucauaggcccaggauuacaggcaaaagccacucgugaagcucaaaaaaggacagcugcuggaauaaugaagaauccaacaguggaugggauaaugacaauagaccuagacccugugauauacgauucaaaauuugaaaaacaacuaggacaggucaugcuucuaguauugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggaaagaacagaagccaaagaaggguugaaaagaggagaaauaacacaccaugccguguccagaggcagcgcaaaacuucaaugguucguggagagaaacauggucauccccgaaggaagagucauagauuuaggcuguggaagaggaggcuggucauauuauugugcaggacugaaaaaaguuacagaagugcgaggauacacaaaaggcggcccaggacaugaagaaccaguacccaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguauuggauaucuaauggcacaggcaauaucguuucuucugucaacaugguauccagauugcuacugaacagauucacaaugacacauaggagacccaccauagaaaaagauguggauuuaggagcggggacccgacauguuaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaagaguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgcuguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagauaucuccaagauacccggaggagcuauguaugcugaugacacagcugguugggacacaagaauaacagaagaugaccugcacaaugaggaaaaaaucacacagcaaauggacccugaacacaggcgguuagcaaacgcuauauucaagcucacauaccaaaacaaaguggucaaaguucaacgaccaacuccaaagggcacgguaauggacaucauaucuaggaaagaccaaagaggcaguggacagguggggacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaauugaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccacaggaugaauuaaucgggagagcuagaaucucucaaggagcaggauggagccucagagaaacugcaugccuagggaaagccuacgcccaaaugugggcccucauguacuuucacagaagagaucuuagacuagcauccaacgccauauguucagcagugccaguccauugggucccuacaagcagaacgacguggucuauucacgcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucgcuuccagagcaaccugggcccagaacauacuuacggcaauucaacaggugagaagccuuauaggcaaugaagaguuucuggacuacaugccuucaaugaagagauucaggaaggaggaggagucagagggagccauuugguaa

SEQ ID NO: 7697 - RNA, 9873 nt, Artificial Sequence
  derived and/or modified CDS sequence (wt) from DENV-3__JN697379__SS-prME
acaucgcucugucucaugaugauguuaccagcaacacuugcuuuccacuuaacuucacgagauggagagccgcgcaugauuguggggaagaaugaaagaggaaaaucccuacuuuuuaagacagccucuggaaucaacaugugcacacucauagccauggauuugggagagaugugugaugacacggucacuuacaaaugcccccacauuaccgaaguggagccugaagacauugacugcuggugcaaccuuacaucgacaugggugacuuauggaacaugcaaucaagcuggagagcauagacgcgauaagagaucaguggcguuagcuccccaugucggcaugggacuggacacacgcacucaaaccuggaugucggcugaaggagcuuggagacaagucgagaagguagagacaugggcccuuaggcacccaggguuuaccauacuagcccuauuucuugcccauuacauaggcacuuccuugacccagaaagugguuauuuuuauacuauuaaugcugguuaccccauccaugacaaugagaugugugggaguaggaaacagagauuuuguggaaggccuaucgggagccacguggguugacguggugcucgagcacggugggugugugacuaccauggcuaagaacaagcccacgcuggacauagagcuucagaagaccgaggccacccaacuggcgacccuaaggaagcuaugcauugagggaaaaauuaccaacauaacaaccgacucaagaugucccacccaaggggaagcgauuuuaccugaggagcaggaccagaacuacguguguaagcauacauacguggacagaggcuggggaaacgguugugguuuguuuggcaagggaagcuuggugacaugcgcgaaauuucaauguuuagaaucaauagagggaaaaguggugcaacaugagaaccucaaauacaccgucaucaucacagugcacacaggagaccaacaccaggugggaaaugaaacgcagggaguuacggcugagauaacaucccaggcaucaaccgcugaagucauuuuaccugaauauggaacccucgggcuagaaugcucaccacggacagguuuggauuucaaugaaaugauuuuauugacaaugaagaacaaagcauggaugguacauagacaaugguucuuugacuuaccccuaccauggacaucaggagcuacaacagaaacaccaacuuggaacaggaaagagcuucuugugacauuuaaaaaugcacaugcaaaaaagcaagaaguaguuguccuuggaucacaagagggagcaaugcauacagcacugacaggagcuacagagauccaaaccucaggaggcacaaguauuuuugcggggcacuuaaaauguagacucaagauggacaaauugaaacucaaggggaugagcuaugcaaugugcuugaauaccuuuguguugaaaaaagaagucuccgaaacgcagcaugggacaauacucauuaagguugaguacaaaggggaagaugcacccugcaagauuccuuucuccacggaggauggacaagggaaagcucacaauggcagacugaucacagccaauccaguggugaccaagaaggaggagccugucaacauugaggcugaaccuccuuuuggggaaaguaauauaguaauuggaauuggagacaaagcccugaaaaucaacugguacaggaagggaagcucgauugggaagauguucgaggccacugccagaggugcaaggcgcauggccaucuugggagacacagccugggacuuuggaucagugggugguguuuugaauucauuagggaaaaugguccaccaaauauuugggagugcuuacacagcccuauuuaguggagucuccuggauaaugaaaauuggaauagguguccucuuaaccuggauaggguugaauucaaaaaacacuucuaugucauuuucaugcauugcgauaggaaucauuacacucuaucugggagucguggugcaagcugacauggggugugucauaaacuggaaaggcaaagaacucaaauguggaaguggaauuuucgucacuaaugagguccacaccuggacagagcaauacaaauuucaagcagacucccccaaaagacuggcaacagccauugcaggcgcuugggagaauggagugugcggaauuaggucaacaaccagaauggagaaccucuuguggaagcaaauagccaaugaacugaacuacauauuaugggaaaacaacauuaaauuaacgguaguuguaggcgacauaacuggggucuuagagcaagggaaaagaacacuaacaccacaacccauggagcuaaaauauucuuggaaaacauggggaaaggcaaaaauagugacagcugaaacacaaaauuccucuuucauaauagaugggccaagcacaccggaguguccaagugccucaagagcauggaaugugugggagguggaagauuacggguucggaguuuucacaaccaacauauggcugaaacuccgagagguguacacccaacuaugugaccauaggcuaaugucggcagccgucaaggaugagagggccguacacgccgacaugggcuauuggauagaaagccaaaagaauggaaguuggaagcuagaaaaagcaucccucauagaggugaaaaccugcacauggccaaaaucacacacucuuuggagcaauggugugcuagagagugacaugauuaucccaaagagucuagcuggucccauuucgcaacacaaccacaggcccggguaccacacccaaacggcaggacccuggcacuuaggaaaauuggagcuggacuucaacuauugugaaggaacaacaguugucaucucagaaaacugugggacaagaggcccaucauugagaacaacaacagugucagggaaguugauacacgaaugguguugccgcucgugcacacuuccuccccugcgauacaugggagaagacggcugcugguauggcauggaaaucagacccauuaaugagaaagaagagaacaugguaaagucucuagccucagcagggaguggaaagguggacaacuucacaaugggugucuuguguuuggcaauccucuuugaagaggugaugagaggaaaauuugggaaaaaacacaugauugcagggguucucuucacguuugugcuccuccucucagggcaaauaacauggagagacauggcgcacacacucauaaugauuggguccaacgucucugacagaauggggaugggcgucacuuaccuagcucuaauugcaacauuuaaaauucagccauucuuggcuuugggauucuuccugaggaaacugacaucuagagaaaauuuauugcugggaguuggguuggccauggcagcaacguuacgacugccagaggacauugaacaaauggcgaauggaauugcuuuggggcucauggcucuuaaacugauaacacaauuugaaacauaccaacuauggacggcauuaguuucccuaacguguucaaauacaauuuucacguugacuguugccuggagaacagccacucugauuuuagccggaauuucgcuuuugccagugugccagucuucgagcaugaggaaaacagauuggcucccaaugacuguggcagcuaugggaguuccaccccuaccacuuuuuauuuucagucugaaagauacacucaaaaggagaagcuggccacugaaugagggggugauggcaguuggacuugugagcauucuagcuaguucucuccuuaggaaugaugugcccauggcuggaccauuaguggcugggggcuugcugauagcgugcuacgucauaacuggcacgucagcagaccucacuguagaaaaagcagcagauguaacaugggaggaagaggccgagcaaacaggagugucccacaauuuaaugaucacaguugaugaugauggaacaaugagaauaaaagaugacgagacugagaacaucuuaacagugcuuuuaaaaacagcacuacuaauaguaucaggcaucuuuccauacuccauacccgcaacacuguuggucuggcauacuuggcaaaagcaaacccaaagauccggcguccuaugggacguacccagccccccagagacacagaaagcggaacuggaagaaggggucuauaggaucaaacagcaaggaauuuuugggaaaacccaaguggggguuggaguacagaaagaaggaguuuuccacaccauguggcacgucacaagaggggcaguguugacacacaaugggaaaagacuggaaccaaacugggcuagcgugaaaaaagaucugauuucauacggaggaggauggagauugagugcacaauggcaaaagggggaggaggugcagguuauugccguagagccugggaagaacccaaagaacuuucaaaccaugccaggcauuuuucagacaacaacaggggaaauaggagcaauugcacuggauuucaagccuggaacuucaggaucucccaucauaaacagagagggaaagguagugggacuguauggcaauggagugguuacaaagaauggaggcuaugucaguggaauagcgcaaacaaaugcagaaccagauggaccgacaccagaguuggaagaagagauguucaaaaagcgaaaucuaaccauaauggaucuucauccugggucaggaaagacgcggaaauaucuuccagcuauuguuagagaggcaaucaagagacgcuuaaggacucuaauuuuggcaccaacaaggguaguugcagcugagauggaagaagcauugaaagggcucccaauaagguaucaaacaacugcaacaaaaucugaacacacaggaagagagauuguugaucuaaugugucacgcaacguucacaaugcgcuugcugucaccagucaggguuccaaacuacaacuugauaauaauggaugaggcucauuucacagacccagccaguauagcggcuagaggguacauaucaacucguguaggaaugggagaggcagccgcaauuuucaugacagcaacacccccuggaacagcugaugccuuuccucagagcaacgcuccaauucaagaugaagagagagacauaccggaacgcucauggaauucaggcaaugaauggauuacugacuuuguugggaagacagugugguuugucccuagcaucaaagccggaaaugacauagcaaacugcuugcggaaaaauggaaaaaaggucauucaacucagcaggaagaccuuugacacagaauaucaaaagaccaaacugaaugauugggacuuuguggugacaacagacauuucagaaaugggagccaauuucaaagcagauagagugaucgacccaagaagaugucucaagccggugauuuugacagauggacccgagcgggugauccuggcuggaccaaugccagucaccguagcgagcgcugcgcaaaggagagggagaguuggcaggaacccacaaaaagaaaaugaccaguacauauucaugggccagccucucaacaaugaugaagaccaugcucacuggacagaagcaaaaaugcugcuggacaacaucaacacaccagaagggauuauaccagcucucuuugaaccagaaagggagaagucagccgccauagacggcgaauaccgccugaagggugaguccaggaagacuuucguggaacucaugaggaggggugaccucccaguuuggcuagcccauaaaguagcaucagaagggaucaaauauacagauagaaaauggugcuuugauggagaacguaauaaucaaauuuuagaggagaauauggauguggaaaucuggacaaaggaaggagaaaagaaaaaacugagaccuagguggcuugaugcccgcacuuauucagauccuuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacgauggaaacacucuuacuccugggacugaugaucuuguuaacagguggagcaaugcucuucuugauaucagguaaagggauuggaaagacuucaauaggacucauuuguguaauugcuuccagcggcauguuauggauggcugaugucccacuccaauggaucgcgucggcuauaguccuggaguuuuuuaugaugguguugcucauaccagaaccagaaaagcagagaacuccccaagacaaccaacucgcauaugucgugauaggcauacuuacauuggcugcaauaguagcggccaaugaaaugggacuguuggaaacuacaaagagagauuuaggaaugucuaaagaaccagguguuguuucuccaaccagcuauuuggauguggacuugcacccagcaucagccuggacauuguacgccguggccacaacaguaauaacaccaauguugagacacaccauagagaauuccacagcaaaugugucccuggcagccauagcuaaccaggcagugguccugauggguuuagacaaaggauggccgauaucgaaaauggacuugggcguaccacuauuggcacuggguugcuauucacaagugaacccacuaacucuugcagcggcaguacuuuugcuagucacacauuaugcaauuauagguccaggauugcaggcaaaagccacucgugaagcucaaaaaaggacagcugcuggaauaaugaagaauccaacgguggauggaauaaugacaauagaccuagauccuguaauauaugauucaaaauuugaaaagcaacuaggacagguuaugcuccugguucugugugcaguucaacuuuuguuaaugagaacaucaugggccuugugugaaguucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuuaggagaaaaguggaaaaagaaauuaaaucaguuaucccggaaagaguuugaccuuuacaagaaauccggaaucaccgaaguggauagaacagaagccaaagaaggguuaaaaagaggagaaauaacacaccaugccguguccagaggcagcgcaaaacuucaaugguucguggagagaaacauggucauucccgaaggaagagucauagacuuaggcuguggaagaggaggcuggucauauuacugugcaggacugaaaaaaguuacagaagugcgaggauacacaaaaggcggcccaggacacgaagaaccaguaccuaugucuacauacggauggaacauagucaaguuaaugaguggaaaggauguuuuuuaucugccaccugaaaagugugauacccuauugugugacauuggagaaucuucaccaagcccaacaguggaagaaagcagaaccauaagagucuugaagaugguugaaccauggcuaaaaaacaaccaguuuugcauuaaaguauugaacccauacaugccaacugugauugagcacuuagaaagacuacaaaggaaacauggaggaaugcuugugagaaauccacucucacgaaacuccacgcacgaaauguauuggauauccaaugguacaggcaacaucgucucuucagucaacaugguauccagauugcuacugaacagauucacaaugacacacaggagacccaccauagagaaagauguggauuuaggagcaggaacccgacaugucaaugcggaaccagaaacacccaacauggaugucauuggggaaagaauaaaaaggaucaaagaggagcauaguucaacauggcacuaugaugaugaaaauccuuacaaaacgugggcuuaccauggauccuaugaaguaaaagccacaggcucagccuccuccaugauaaauggagucgugaaacuccucacaaaaccaugggauguggugcccauggugacacagauggcaaugacagauacaacuccauuuggccagcaaagaguuuuuaaagagaaaguggacaccaggacaccuaggcccaugccaggaacaagaaagguuauggagaucacagcggaguggcuuuggaggacccugggaaggaacaaaagacccagauuaugcacaagggaggaguucacaaagaaggucagaaccaacgcagcuaugggcgcugucuucacagaagagaaccaaugggacagugcgagagcugcuguugaggacgaagaauuuuggaaacuuguggacagagaacgugaacuccacaaacugggcaaguguggaagcugcguuuacaacaugaugggcaagagagagaaaaaacuuggagaguuugguaaagcaaaaggcaguagggcuauaugguacaugugguugggagccagguaccuugaguucgaggcgcucggauuccucaaugaagaccauugguucucgcgugaaaacucuuacaguggaguagaaggagaaggacugcacaagcugggauacaucuugagagauauuuccaagauacccggaggagccauguaugcugaugacacagccgguugggacacaagaauaacagaagaugaccugcacaaugaggaaaaaaucacacagcagauggacccugaacacaggcagcuagcgaacgcuauauucaagcucacauaccaaaacaaaguggucaaaguccaacgaccaacuccaaagggcacgguaauggacaucauaucuaggaaagaccaaagaggcaguggacaggugggaacuuauggucugaacacauucaccaacauggaagcccagcuaaucagacaaauggaaggagaaggcguguugucaaaggcagaccucgagaacccccauccgcuagagaagaaaauuacacaaugguuggaaacuaaaggaguggagagguuaaaaagaauggccaucagcggggaugauugcguagugaaaccaaucgacgacagauucgccaaugcccugcuugcccugaacgauaugggaaagguuaggaaggacauaccucaauggcagccaucaaagggauggcaugauuggcaacaggucccuuucugcucccaccacuuucaugaauugaucaugaaagauggaagaaaguugguaguucccugcagaccccaggacgaacuaauaggaagagcgagaaucucucaaggagcaggauggagccuuagagaaacugcaugucuagggaaagccuacgcucaaauguggacucucauguauuuucacagaagagaucuuagacuagcauccaacgccauauguucagcaguaccaguccauuggguccccacgagcagaacgacauggucuauucaugcucaccaucaguggaugacuacagaagacaugcuuacugucuggaacaggguguggauagaggacaauccauggauggaagacaaaacuccagucacaacgugggaagauguuccauaucuagggaagagagaagaccaauggugcggaucacucauaggucucacuuccagagcaaccugggcccagaacauacucacagcaauccaacaggugagaagccucauaggcaaugaagaguuucuggacuacaugccuucgaugaagagauucaggaaggaggaggagucagagggagccauuugguaa

SEQ ID NO: 7698 - RNA, 9873 nt, Artificial Sequence
  derived and/or modified CDS sequence (wt) from DENV-3__JQ045687__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacagucacuuacaaaugcccccucguugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaagccacccaacuggcgacccuaaggaaguuaugcauugagggaaaaauuaccaacauaacaacugacucaagguguccuacccaaggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcagugguucuuugaccuaccccuaccauggacaucaggagcuacaacagagacaccaacuuggaacaagaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcacccugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaaucaacugguacaagaagggaagcucaauugggaagauguucgaggccacugccagaggugcaaggcgcauggccaucuugggagacacagccugggacuuugguucagugggugguguucuaaauucacuagguaaaauggugcaccaaauauucggaagugcuuacacagcccuguuuaguggagucucauggauaaugaaaauuggaauagguguccucuuaaccuggauaggguuaaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccgaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccacaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacauaaccacaggccuggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccuccauuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacucugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauuuuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagauggaccgacaccggaauuggaagaagaaauguucaaaaagcgaaaucuaaccacaauggaucuucauccugggucaggaaagacgcggaaauaucuuccagccaucgucagagaagcaaucaagagacguuuaagaacucuaauuuuggcaccaacaagaguaguugcagcugagauggaagaagcacugaaaggacucccaauaagguaucaaacaacugcaacaaaaucugaacacacaggaagggagauuguugaucuaaugugccacgcaacauucacaaugcguuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggacauuccggaacgcucauggaauucaggcaaugaauggauuaccgacuuuguuggaaagacggugugguuuguaccuagcaucaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucuuaauaaugacgaagaccaugcucacuggacagaagcaaaaaugcugcuagacaacaucaacacaccagaagggaucauaccagcucucuuugaaccagagagggagaagucagccgcuauagauggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuagcacugggcugcuauucacaagugaacccacugacucucacagcggcaguacuucugcuaguuacacauuaugccauuauagguccaggauugcaggcuaaagccacucgugaggcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuugggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuagguuguggaagaggaggcuggucauauuauugcgcaggacugaaaaaagucacagaagugcgaggauacacaaaagguggcccaggacacgaagaaccaguaccuauguccacauacggauggaacauagucaagcuaaugaguggaaaggauguguuuuaucuuccaccugagaagugugacacccuauugugugacauuggagaaucaucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggauguaguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauucaagcucacauaucaaaacaaaguggucaaaguucaacgaccaacuccaaaaggcacgguaauggacaucauaucuagaaaagaccaaaggggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggauauaccucaauggcagccaucaaagggguggcaugauuggcaacaagucccuuucugcucccaccacuuucaugaacugaucaugaaagauggaagaaaguuggugguucccugcagaccccaggacgaacugauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcagugccgguccauuggauccccacaagcagaacgacauggucuauucacgcucaccaucaguggaugaccacagaagacaugcuaacuguuuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7699 - RNA, 9873 nt, Artificial Sequence
  derived and/or modified CDS sequence (wt) from DENV-3__JQ045689__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcgcuggcuccccauguuggcaugggacuggacacacguacccaaacuuggaugucggcugaaggagcuuggagacaauuugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacguuggacauagagcuucagaagaccgaggccacccaacuggcgacccuaaggaaguuaugcauugagggaaaaauuaccaacauaacaacugacucaagguguccuacccagggggaagcgauucuaccugaagagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccuuaaauacacugucaucaucacagugcacacaggagaccaacaccaagugggaaaugacacgcagggagucacgguugagauaacaccccaggcaucaaccguugaagccguuuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcauuugaaauguagacuuaagauggacaaauuggaacucaaggggaugagcuaugcaaugugcuugaauacuuuuguguugaagaaagaagucuccgaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcgugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaaggacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuuuacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggccuggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacgguugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacauacacucauaaugauuggguccaacgcuucugacaggaugggaaugggcguuaccuacuuagcuuuaauugcaacauucaaaauccagccauucuuggccuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaauuguggacagcauuagucuccuuaacguguucaaacacaauuuucacgcugacuguugccuggagaacagccaccuugauucuggccggaguuucacuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcacuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaacgguggcuacgucaguggaauagcgcaaacaaaugcagaaccagacggaccgacaccggaauuagaagaagaaauguucaaaaagcgaaaucuaaccauaauggaucuccauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaaccgcaacaaaaucugaacacacaggaagggagauuguugaucuaaugugccacgcaacauucacaaugcgcuugcuaucaccagucaggguuccaaauuacaauuugauaauaauggaugaggcccauuucacagauccagcuaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuagcagaaagacuuuugauacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccacgcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaaaucaauugcccuugaucuugugacagaaauaggaagagugccuucacacuuagcccacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggagucguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaagucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacaucuuuagagggagcuacuuggcaggagcugggcuugcuuuuucuaucaugaaaucaguuggaacaggaaggagaggaacggggucacaaggcgaaaccuugggagaaaaguggaaaaagaaauuaaaucaguuaucccggaaagaguuugaucuuuauaagaaaucuggaaucacugaaguggauagaacagaagccaaagaaggguugaaaagaggagaaacaacacaucaugccguguccagaggcagcgcaaaacuucaaugguucguggagaggaacauggucacucccgaaggaagagucauagacuuaggcuguggaagaggaggcuggucauauuacugcgcaggacugaaaaaaguuacagaagugcgaggauacacaaaagguggcccaggacaugaagaaccaguaccuauguccacauacggauggaacauagucaagcuaaugaguggaaaggacguguuuuaucuuccaccugagaagugugacacccuauugugugacauuggagaaucuucaccaagcccaacaguggaagaaagcagaacuauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaauauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugcgucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuugagagauauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagauuaaaaagaauggccaucagcggagaugauugcguggugaaaccgauugaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccucaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauauuccauaccuagggaagagagaagaucaauggugcggaucacuuauuggucucaccuccagagcaacaugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7700 - RNA, 9873 nt, Artificial Sequence
  derived and/or modified CDS sequence (wt) from DENV-3__JQ045691__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauauuggcaugggacuggacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuagucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagacagaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcaaaauuucaaugucuagaaccaauagagggaaaaguggugcaauaugagaaucuuaaauacacugucaucaucacagugcacacaggagaccaacaccaagugggaaaugauacgcagggagucacgguugagauaacaccccaggcaucaaccguugaagccaucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaucucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcucacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacacuuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaacuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaagaggagcuggccacugaaugagggagugauggcuguugggcuugugagcauucuagccaguucucuccuuaggaaugaugugcccauggcuggaccacuaguggccgggggcuuguugauagcgugcuaugucauaacuggcacgucagcagaccucacuguagagaaggcagcagauguaacaugggaggaagaagcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuacugacuuuguuggaaagacggugugguuuguaccuagcauuaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagagaugggagccaauuuuaaagcagauagagugauugacccaagaagaugucucaagccaguaauuuugacggauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccuucuaucagguaaagggauuggaaagacuucaauaggacucauuuguguuauaguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaauuacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguacccauguccacauacggauggaaccuagucaagcuaaugaguggaaaggacguguuuuaucuuccaccugagaagugugacacccuauugugugacauuggagaaucuucaccaaguucaacaguggaagaaagcagaaccauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaacccacucucacgaaauuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacaugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccagggccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacuuggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccagagaggcaguggacagguggggacuuauggucugaacacauucaccaacauggaagcccaguuggucagacagauggaaggagaaggcguguugucgaaggcagaccucgagaacucucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaaggucaggaaggacauaccucaauggcagccaucaaagggguggcaugauuggcaacaggucccuuucugcucccaccacuuucaugaacugaucaugaaagauggaagaaagcuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccaucugguaa

SEQ ID NO: 7701 - RNA, 9873 nt, Artificial Sequence
  derived and/or modified CDS sequence (wt) from DENV-3__JQ045692__SS-prME
acaucgcucugccucaugaugauguuaccagcaacacuugcuuuccaccugacuucacgcgauggagagccgcgcaugauuguggggaagaaugaaagagggaaauccuuacuuuuuaagacagcuucuggaaucaacaugugcacacucauagcuauggacuugggagagaugugugaugacacggucacuuauaaaugcccccucauugccgaaguggaaccugaagacauugauugcuggugcaaccuuacaucgacaugggugacuuauggaacgugcaaucaagcuggggagcauagacgcgacaagagaucaguggcguuggcuccccauguuggcaugggacuagacacacguacccaaaccuggaugucggcugaaggagcuuggagacaaguugaaaagguagagacaugggcucuuaggcacccagguuucaccauacuagcucuauuccuugcccauuacauaggcacuucccugacccagaaagugguuauuuuuauacuacuaaugcuagucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagacagaggccacccaacuggcgacccuaaggaaguuaugcauugagggaaaaauuaccaacauaacaacugacucaagguguccuacccagggggaagcgauucuaccugaggagcaggaccagaacuacguguguaagcacacauacguggauagagguuggggaaacgguugugguuuguuuggaaaaggaagcuuggugacaugcgcgaaauuucaaugucuagaaccaauagagggaaaaguggugcaauaugagaaucuuaaauacacugucaucaucacagugcacacaggagaccaacaccaagugggaaaugauacgcagggagucacgguugagauaacaccccaggcaucaaccguugaagccaucuugccugaguauggaacccuugggcuagaaugcucaccacggacaggcuuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaucucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaaggucgaguacaaaggggaagaugcaccuugcaagauuccuuucuccacagaggauggacaagggaaagcucacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucuaaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaacuugcuguugggaguuggguuggccauggcaacaacguuacaacugccagaggacauugaacaaauggcgaauggaauugcucuggggcucaugacucuaaaacugauaacacaauuugagacauaucaguuguggacagcauuagucuccuuaacguguucaaauacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaaggaggagcuggccacugaaugagggagugauggcuguugggcuugugagcauucuagccaguucucuccuuaggaacgaugugcccauggcuggaccacuaguggccgggggcuuguugauagcgugcuaugucauaacuggcacgucagcagaccucacuguagagaaggcagcagauguaacaugggaggaagaggcugagcaaacaggagugucccacaauuugaugaucacaguugaugaugauggaacaaugagaauaaaggaugaugagacugagaacauucuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaagcacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuucagacaacaacgggggaaauaggagcaauugcacuagacuucaagccuggaacuucaggaucuccuaucauaaacagagagggaaagguagugggacuguauggcaauggagugguuacgaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacguuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaaucugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcauuaaagcuggaaaugacauagcaaacugccugcggaaaaaugggaaaaaggucauccaacuuaguagaaagacuuuugauacagaauaucaaaagaccagacugaaugauugggacuucguggugacaacagacauuucagagaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggccagccucucaacaaugacgaagaccaugcucacuggacagaagcaaaaaugcugcuagacaacaucaacacaccagaggggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaacaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggccuacaggcaugcaguggaggaacuaccagaaacaauggaaacauuccuacucuugggacucaugaucuuauuaacagguggagcaaugcuuuuccuucuaucagguaaagggauuggaaagacuucaauaggacucauuuguguuauaguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccaggcguuguuucuccaaccagcuauuuagauguagacuugcacccagcaucagccuggacauuguacgccguggccacaacaguaauaacaccaauguugagacacaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggcuaacauuuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaauuacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaagguggcccaggacacgaagaaccaguaccuauguccacauacggauggaaccuagucaagcuaaugaguggaaaggacguguuuuaucuuccaccugagaagugugacacccuauugugugauauuggagaaucuucaccaaguucaacaguggaagaaagcagaaccauaagagucuugaagaugguugagccauggcuaaaaaacaaccaguuuugcauuaaaguauuaaacccuuacaugccaacugugauugagcaccuagaaagauuacaaagaaaauauggaggaaugcuugugagaaauccacucucacgaaauuccacgcaugaaauguacuggauauccaaugguaccggcaacaucgucucuucagucaacaugguauccagauugcuacugaacagauuuacgaugacacacaggagacccaccauagagaaagauguggacuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccagggccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaagaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacuuggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccagagaggcaguggacagguggggacuuauggucugaacacauucaccaacauggaagcccaguuggucagacagauggaaggagaaggcguguugucgaaggcagaccucgagaacccucaucugcuagagaagaaaaucacacaaugguuggaaaccaaaggaguggagagguuaaaaagaauggccaucagcggagaugauugcguggugaaaccgauugaugacagguuugccaaugcccugcuugcccugaacgacaugggaaaggucaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccaucugguaa

SEQ ID NO: 7702 - RNA, 9873 nt, Artificial Sequence
  derived and/or modified CDS sequence (wt) from DENV-3__JQ045694__SS-prME
acaucgcucugccucaugaugauguuaccagcaacacuugcuuuccaucugacuucacgcgauggagagccgcgcaugauuguggggaagaaugaaagagggaaauccuuacuuuuuaagacagcuucuggaaucaacaugugcacacucauagccauggacuugggagagaugugugaugacacggucacuuauaaaugcccccucauugccgaaguggaaccugaagacauugauugcuggugcaaccuuacaucgacaugggugaccuauggaacgugcaaucaagcuggggagcauagacgcgacaagagaucaguggcguuggcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcuugagcacggugggugugugaccacuauggcuaagaacaagccuacgcuggacauagagcuucagaagaccgaggccacccaacuggcgacccuaaggaaguuaugcauugagggaaaaauuaccaacauaacaacugacucaagguguccuacccaaggggaagcgauucuaccugaggagcaggaucagaacuacguguguaagcacacauacguggauagagguuggggaaacgguugugguuuguuuggaaaaggaagcuuggugacaugcgcgaaauuucaaugucuagaaccaauagagggaaaaguggugcaguaugagaaccuuaaauacacugucaucaucacagugcacacaggagaccaacaccaagugggaaaugauacgcagggagucacgguugagauaacaccccaggcaucaaccguugaagccgucuugccugaguauggaacccuugggcuagaaugcucaccacggacaggcuuggauuucaaugaaaugauuuuauugacaaugaaaaacaaagccuggaugguacauaggcaaugguuuuuugaccuaccccuaccauggacaucaggagcuacaacagagacaccaacuuggaacaggaaagagcuucuuguaacauucaaaaaugcacaugcaaaaaagcaagaagugguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugccugaauaccuuuguguugaagaaagaagucucugaaacgcagcaugggacaauacucauuaaggucgaguacaaaggggaagaugcaccuugcaagauuccuuucuccacagaggauggacaagggaaagcccacaaugguagauugaucacagccaacccaguggugaccaagaaggaggagcccgucaacauugaggcugaaccuccuuuuggggaaagcaacauagugauuggaauuggagacaaagccuugaaaauuaacugguacaagaagggaagcucaauugggaagauguucgaggccacugccagaggugcaaggcgcauggccaucuugggagacacagccugggacuuugguucagugggugguguucugaauucacuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgccauaaacuggaaaggaaaagaacucaaauguggaaguggaauuuuugucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggugacauaauuggggucuuagagcaagggaaaagaacauuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuuuacaaccaacauauggcugaaacuccgagagguguacacccaaucaugcgaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcuggucccauuucacaacacaaccacaggccuggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuuacgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagacauggcacacacacucauaaugauuggguccaacgcuucugacaggaugggaaugggcguuaccuacuuggcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucugaaacugauaacacaauuugagacauaucaguuguggacagcauuagucuccuuaacguguucaaacacaauuuucacgcugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacaccaaaaagaaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaagcugagcaaacaggagugucccacaacuugaugaucacaguugaugaugauggaacaaugagaauaaaggaugaugagacugagaacauucuaacagugcucuuaaaaacagcauuacugauaguaucaggcaucuuuccauacuccauaccugccacacuguuggucuggcauacuuggcaaaagcaaacccaaagaucuggcguucuaugggacguacccagccccccagaaacacagaaagcagaacuggaagaggggguuuauaggaucaaacaacaaggaauuuuugggaaaacccaaguggggguuggagugcagaaagaaggagucuuccacaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuccaaaccaugccgggcauuuuccagacaacaacgggggaaauaggagcaauugcacuagacuucaagccuggaacuucaggaucuccuaucauaaacagagagggaaagguagugggacuguauggcaauggaguggucacgaaaaaugguggcuacgucaguggaauagcgcaaacaaaugcagaaccagacggaccgacaccggaauuggaagaagaaauguucaaaaagcgaaaccugaccauaauggaucuucauccugggucaggaaagacgcggaaauaccuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuugcuaucaccaaucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguuggaaagacggugugguuuguaccuagcaucaaagcuggaaaugacauagcaaacugccugcggaaaaauggaaaaaaggucauccaacuuaguagaaagacuuuugacacagaauaucaaaagaccagacugaaugauugggacuucguggugacaacagacauuucagaaaugggagccaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaggaaaaugaccaguacauauucacgggucagccucucaacaaugaugaagaccaugcccacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggagaccucccaguuuggcuagcccauaaaguagccucagaagggaucaaauacacagauagaaaauggugcuuugauggagaacguaauaaucaaauuuuagaagagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagccuacagaacgagaaacgcccuggacaacuuggugaugcugcacacgucagaacauggcgguagggccuacaggcaugcaguggaggaacuaccagaaacaauggaaacacuccuacucuugggacucaugaucuuauuaacagguggagcaaugcuuuuccugaugucagguaaagggauuggaaagacuucaauaggacucauuuguguuauuguuuccaguggcauguuauggauggcugaugucccacuucaauggaucgcgucggcuauaguccuggaauuuuucaugauggugcugcucauaccagaaccagaaaaacaaagaacuccccaagacaaccaacucgcauaugucgugauaggcauacuaacacuggcugcgauaguagcagcuaaugaaaugggauuauuggaaacuacaaagagagacuuaggaaugucuaaagaaccagguguuguuucuccaaccagcuauuuagauguagacuugcacccagcaucagccuggacacuguacgccguggccacaacaguaauaacaccaauguugagacacaccauagagaauuccacagcaaauguaucccuggcagccauagccaaccaggcagugguccugauggguuuagacaaaggauggccaauaucgaaaauggaccuaggcguaccgcuacuggcacugggcugcuauucacaagugaacccacugacucucacggcggcaguacuucugcuaguuacacauuaugccauuauagguccaggauugcaggcuaaagccacucgugaagcucaaaaaagaacagcugcuggaauaaugaagaauccaacgguggaugggauaaugacaauagaucuagauccuguaauauacgauucgaaauucgaaaagcaacuaggacaggucaugcuccugguucugugugcaguucaacucuuguuaaugagaacaucaugggcauugugugaagcucuaacccuagccacaggaccaauaacaacacucugggaaggaucaccuggaaaguuuuggaacaccacgauagcuguuuccauggccaacauuuuuagagggagcuacuuagcaggagcugggcuugcuuuuucuaucaugaaaucaguuggaacaggaaggagaggaacggggccacaaggugaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaggugcgaggauacacaaaagguggcccaggacacgaagaaccaguacccaugucuacauacggauggaaccuagucaagcuaaugaguggaagggacguguuuuaucuuccaccugagaagugugacacccuauugugugacauuggagaaucuucaccaagcccaacaguggaagaaagcagaacuauaagagucuugaagaugguugagccauggcuaaaaaacaaccaauuuugcauuaaaguauuaaacccuuacaugccaacugugauugagcaccuagaaagauuacaaagaaaauauggaggaaugcuugugagaaacccacucucacgaaacucuacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacagagaacgugaacuccacaaauugggcaaguguggaagcugugucuacaauaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuagaaaagaccaaagaggcaguggacagguggggacuuauggucugaacacauuuaccaacauggaagcccaguuggucagacagauggaaggagaaggcguguugucgaaggcagaccucgagaacccucaucuacuagagaagaaaaucacacaauggcuggaaaccgaaggaguggagagauuaaaaagaauggccaucagcggagaugauugcguggugaaaccgauugacgacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauuggaucccuacaagcagaacgacauggucuauucacgcucaccaucaguggaugaccacagaagacaugcuaaccgucuggaacaggguguggauagaggacaauccauggauggaagacaaaaccccagucacaacuugggaagauguuccauaccuagggaagagagaagaucaauggugcggaucacucauuggucucacuuccagagcaaccugggcccagaacauacucacggcaauccaacaggugagaagccuuauaggcgaugaagaauuucuggacuacaugccuucgaugaagagauucaggaaggaggaggagucagagggagccauuugguaa

SEQ ID NO: 7703 - RNA, 9873 nt, Artificial Sequence
  derived and/or modified CDS sequence (wt) from DENV-3__GU363549__SS-prME
acaucgcucugucucaugaugauauugccagcagcacuugcuuuccacuugacuucacgagauggagagccgcgcaugaucguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccucaggcacccaggguucaccauacuagcccuauuucuugcccauuacauaggcaccuccuugacccagaaggugguuauuuuuauacuacuaaugcuggucaccccauccaugacaaugagaugugugggagugggaaacagggauuuuguggaaggucugucaggagcuacauggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagaugccccacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaguauaccgucaucauuacagugcacacaggagaccaacaccaggugggaaaugaaacgcagggagucacggcugagauaacgccucaggcaucaaccacugaagccaucuugccugaauauggaacccuugggcuagagugcucaccacggacagguuuggacuucaaugaaaugaucuuacuaacaaugaagaauaaagcauggaugguacacagacaaugguuuuuugaccuaccucuaccauggacaucaggagcuacaacagaaacaccaacuuggaacaggaaggagcuccuugugacauucaaaaacgcacaugcgaaaaaacaagaaguaguuguccuuggaucacaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucggaaacgcagcaugggacaauacucauuaaggucgaguacaaaggggaagaugcaccuugcaagauuccuuucuccacagaggaugaacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaagggaagcucuauugggaagauguucgaggcuacugccagaggugcaaggcgcauggccaucuugggagacacagcuugggacuuuggaucagugggugguguucugaacucauuaggcaaaauggugcaccaaauauucggaagugcuuacacagcccuauucaguggagucuccugggugaugaaaauuggaauagguguucucuugacuuggauaggguugaauucaaaaaacacauccaugucauuuucaugcauugcgauaggaaucaucacacucuaucugggagcagugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcagauagccaaugaacugaacuacauauuaugggaaaauaauauuaaauuaacgguaguugugggcgacacaauuggggucuuggagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaacuaacauauggcugaaacuccgagagguguacacccaaaugugugaccacaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacgagaggcccaucauugagaacaacgacagugucaggaaaguugauacacgaaugguguugccgcucgugcacacuuccuccucugcgauacaugggagaagacggcuguugguaugguauggaaaucagacccaucagugagaaagaagagaacaugguaaagucuuuagucucagcgggaaguggaaagguagacaauuucacaaugggugucuugugcuuggcaauccucuuugaagaggugaugagaggaaaauuugggaagaaacacaugauugcagggguuuuccucacguuuaugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagagaauuuacuguuaggaguuggauuggcuauggcaacaacgauacaacugccagaggacauugaacaaauggcaaauggaaucgcccuagggcucauggcucuuaaauugauaacacaauuugaaacauaccaauuauggacagcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuggccaguucucuccuuagaaaugacgugcccauggcuggaccauuaguggccgggggcuuguugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucugacagugcuuuugaagacagcauuacuaauaguaucagguaucuuuccauacuccauacccgcaacauuguuggucuggcauacuuggcaaaagcaaacccaaagauccgguguuuuaugggacguacccagccccccagagacacagaaagcagaacuggaagaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagaccacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugaaauggaagaagcauugaaagggcucccaauaagguaccaaacaacagcaacaaaaucugaacacacgggaagagagauuguugaucuaaugcgccacgcaacguucacgaugcgcuugcugucaccaguuaggguuccaaauuacaacuugauaauaauggaugaggcccauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccguggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcucacaaaguagcaucagaagggaucaaauacacagauagaaaauggugcuuugauggacagcguaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacuguuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuauuggcauuggguugcuauucacaagugaacccauugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaacuguuguuaaugagaacaucaugggccuugugugaagcccuaacuuuagcuacaggaccaauaacaacacucugggaaggaucaccugggaaguucuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuugggagaaaaauggaaaaagaaacugaaucaauuaucccggaaagaguuugaccuuuacaagaagucuggaaucacugaaguggauagaacagaagccaaagaaggguugaaaagaggagaaacaacacaucaugccguguccagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacacauggauggaacauaguuaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcugaaaaacaaccaguuuugcauuaaaguauugaacccuuacaugccagccgugauugagcaccuagagagacuacaaaggaaacacggaggaaugcuugugagaaauccacuuucacgaaacuccacgcacgaaauguacuggauaucuaaugguacagguaacauugucucuucagucaacaugguauccagacuguuacugaacagguucacgaugacacacaggagaccuaccauagagaaagauguggacuuaggagcaggaacucgacauguuaaugcggaaccagaaacacccaacauggaugucauuggggaaagaauaagaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagauacaacuccauuuggccagcagagaguuuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggugccguuuucacagaggagaaccaaugggacagugcgaaagcugcuguugaggaugaagaauuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacuccuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaaugaacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucuaaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaauugaugacagguucgcuaacgcccugcuugcucugaacgauaugggaaagguucggaaagacauaccucaauggcagccaucaaagggauggcaugacuggcagcagguucccuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuaugcccaaauguggagucucauguauuuucacagaagagaucucagacuagcguccaaugccauauguucagcaguaccaguccacuggguccccacaaguagaacgacauggucuauucaugcucaccaucaguggaugacuacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucacuuccagagcaaccugggcccagaacauauccacagcaauucaacaggugagaagccuuauaggcaaugaagaguuucuggacuacaugccuucaaugaagagauucaggaaggaggaggagucggagggagccauuugguaa

SEQ ID NO: 7704 - RNA, 9873 nt, Artificial Sequence
  derived and/or modified CDS sequence (wt) from DENV-3__KJ622197__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucaaaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7705 - RNA, 9873 nt, Artificial Sequence
  derived and/or modified CDS sequence (wt) from DENV-3__KJ622198__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucaaaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuuuaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7706 - RNA, 9873 nt, Artificial Sequence
  derived and/or modified CDS sequence (wt) from DENV-3__KJ622191__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacaccgucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaagugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaagcaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcgcaauggcaaaagggagaggaagugcagguuauugccguagagccugggaggaacccaaaaaacuuucaaaccaugccggguauuuuucagacaacaaugggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucagaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7707 - RNA, 9873 nt, Artificial Sequence
  derived and/or modified CDS sequence (wt) from DENV-3__KJ622192__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucagaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7708 - RNA, 9873 nt, Artificial Sequence
  derived and/or modified CDS sequence (wt) from DENV-3__KJ622193__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaaggaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucagaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagguuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7709 - RNA, 9873 nt, Artificial Sequence
  derived and/or modified CDS sequence (wt) from DENV-3__KJ622194__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacagugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucagaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacgccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7710 - RNA, 9873 nt, Artificial Sequence
  derived and/or modified CDS sequence (wt) from DENV-3__KJ622195__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauagacagagagggaaaaguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucaaaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7711 - RNA, 9873 nt, Artificial Sequence
  derived and/or modified CDS sequence (wt) from DENV-3__KJ622196__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacacgcacccagaccuggaugucggcugaaggagcuuggagacaagucgagaagguagagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacagcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuauaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggagguacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaaucaacugguacaagaagggaagcucgaucgggaagauguucgaggccacugccagaggugcaaggcgcauggccaucuugggagacacagccugggacuuuggaucaguggguggcguucuaaauucauuagggaaaauggugcaccaaauauucggaagugcuuacacagcccuguuugguggagucucauggauaaugaaaauuggaauagguguucuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuuugucaccaaugagguccacaccuggacagagcaauacaaauuucaagcagacuccccuaaaagacuggcgacggccauugcaggcgcuugggaaaauggagucugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaacauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggaacuggacuucaacuauugugaaggaacaacaguagucaucacagaaaacugugggacaagaggcccaucacugagaacaacaacagugucagggaaguugauacacgaaugguguugccgcucgugcacacucccucccuugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaagcacaugauugcagggguucuccucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaaucgcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacauuguuggucuggcauacuuggcaaaagcaaacccaaagaucugguguucuaugggauguacccagccccccagaaacacagaaagcagaacuggaagagggggucuacaggaucaaacaacaaggaaucuuuggaaaaacccaaguggggguuggaguacagaaagaaggagucuuccacaccauguggcacguuacaagaggggcaguguugacgcacaaugggaaaagacuggaaccaaacugggccagcgugaaaaaagaccugauuucauacggaggaggauggagauugagugcacaauggcaaaagggagaggaagugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagacggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaccuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccccagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggucagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucaaaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaaccccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuggacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaaccuuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguauuggauauccaaugguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacauauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcgagagcugcuguugaggacgaggaauucuggaaacuugugggcagagaacgugaacuccacaaauugggcaaguguggaagcugcguuuacaacaugaugggcaagagagagaagaaacucggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7712 - RNA, 9873 nt, Artificial Sequence
  derived and/or modified CDS sequence (wt) from DENV-3__KJ830751__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacauguguacacucauagccauggauuugggagagaugugugaugacacggucacuuauaaaugcccccacauuaccgaaguggaaccugaagacauugacugcuggugcaaccucacaucaacaugggugacuuauggaacgugcaaucaagcuggagagcacagacgcgacaagagaucaguggcguuagcuccucaugucggcaugggauuggacacacgcacccaaaccuggaugucggcugaaggagcuuggagacaagucgaaaagguagagacaugggcccuuaggcacccaggguuuaccauacuagcccuauuucucgcccauuacauaggcacuuccuugacccagaaggugguuauuuucauauuauuaauguuggucaccccauccaugacaaugagaugugugggaguaggaaacagagauuuuguggaagggcuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugacucaagaugcccuacccaaggggaagcgguuuugccugaggagcaggaccagaacuacguguguaagcauacauacguggacagaggcugggggaacgguugugguuuguuuggcaaaggaagcuugguaacaugugcgaaauuucaaugccuagaaccaauagagggaaaaguggugcaauaugagaaccucaaauacaccguuaucauuacagugcacacaggagaccaacaccaggugggaaaugaaacgcaaggagucacggcugagauaacaccucaggcaucaaccacugaagccaucuugccugaauauggaacccuugggcuagaaugcucaccacggacagguuuggauuucaaugaaaugauuuuacuaacaaugaagaacaaagcauggaugguacacagacaaugguucuucgaccuaccucuaccaugggcaucaggagcaacaacagaaacaccaaccuggaacaggaaggagcuucuugugacauucaaaaacgcacaugcgaaaaaacaagaaguaguuguucuuggaucgcaagagggagcaaugcauaccgcacugacaggagcuacagaaauccaaaacucaggaggcacaagcauuuucgcggggcacuuaaaauguagacuuaagauggacaaauuggaacucaaggggaugagcuaugcaaugugcacgaauaccuuuguguuaaaaaaagaagucucagaaacgcagcacgggacaauacucauuaagguugaguacaagggggaagaugcaccuugcaagauucccuuuuccacagaggauggacaagggaaagcucacaauggcagacugaucacagccaacccuguggugacuaagaaggaggagcccgucaauauugaggcugaaccuccuuuuggggaaagcaauauaguaauuggaauuggagacaacgccuugaaaaucaacugguacaagaaggggagcucgauugggaagauguucgaggccacugccaggggugcaaggcgcauggccaucuugggagacacagcuugggacuuuggaucaguggguggcguucugaauucauuaggcaaaauggugcaccaaauauuuggaagugcuuacacagcccuguucaguggagucucuugggugaugaaaauuggaauagguguccucuugacuuggauaggguugaauucaaaaaacacauccaugucauuuucaugcauugcgauaggaaucauuacacucuaucugggagcugugguacaagcugacauggggugugucauaaacuggaaaggcaaagaacucaaaugcggaagcggaauuuucgucaccaaugagguccacaccuggacagagcaauacaaauuccaagcagacuccccaaaaagauuggcaacagccauugcaggcgcuugggagaauggaguguguggaauuaggucaacaaccagaauggagaaccucuuguggaagcaaauagccaaugaacugaacuacauauuaugggaaaacaauaucaaauuaacaguaguugugggcgauacaauuggggucuuagagcaagggaagagaacacuaacaccacaacccauggagcuaaaauacucauggaaaacguggggaaaggcgaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuacuggauagaaagccaaaagaauggaaguuggaagcuagaaaaagcaucccucauagagguaaaaaccugcacauggccaaaaucacacacucucuggaguaauggugugcuagagagugacaugaucaucccaaagagucuagcugguccuaucucacaacacaacuacaggcccggguaccacacccaaacggcaggacccuggcacuuaggaaaauuggagcuggacuucaacuacugugaaggaacaacaguugucaucacagaaagcuguggaacaagaggcccaucauugagaacaacaacagugucagggaaguugauacacgaaugguguugccgcucgugcacacuucccccccugcgauacaugggagaagacggcugcugguauggcauggaaaucagacccaucagcgagaaagaagagaacaugguaaagucuuuagucucugcaggaaguggaaagguggacaacuucacaaugggugucuuguguuuggcaauccucuaugaagaggugaugagaggaaaauuugggaagaaacacaugauugcagggguuuucuuuacguuugugcuccuucucucagggcaaauaacguggagaaacauggcgcacacacuaauaaugauuggguccaacgccucugacaggaugggaaugggcgucaccuaccuagcucuaauugcaacauuuaaaauccaaccauucuuggcuuugggauuuuuccuaagaaagcugacaucuagagaaaauuuauugcuaggaguuggguuggccauggcaacaacguuacaacugccagaugacauugaacaaauggcaaauggaauugcucuggggcucauggcucuuaaacugauaacacaauuugaaacauaccaauuguggacggcauuagucuccuuaacguguucaaacacaauguuuacguugacuguugccuggaggacagccacucugauuuuggccggaguuucgcuuuuaccagugugccagucuucaagcaugaggaaaacagauuggcucccaauggcaguggcagccaugggaguuccaccccuuccacuuuuuauuuuuaacuugaaagacacacucaaaaggagaaguuggccgcugaaugagggggugauggcuguugggcuugugagcauucuggccaguucccuccuuagaaaugaugugcccauggcugggccauuaguggccgggggcuugcugauagcgugcuacgucauaacuggcacgucagcagaccucacuguagaaaaagcagcagaugugacaugggaggaagaggcugagcagacaggagugucccacaacuuaaugaucacaguugaugaugauggaacaaugagaauaaaagaugaugagauugagaacauccuaacagugcuuuuaaaaacagcauuauuaauaguaucaggcauuuuuccauacuccauacccgcaacauuguuggucuggcacacuuggcaaaaacaaacccaaagauccggcguuuuaugggaugugcccagccccccagagacacagaaagcagaacuggaagaagggguuuauaggaucaaacagcaaggaauuuuugggaaaacccaaguagggguuggaguacagaaagaaggagucuuccacaccauguggcacgucacaagaggagcaguguugacacauaaugggaaaagacuggaaccaaacugggcuagugugaaaaaagaucugauuucauauggaggaggauggagacugagcgcacaauggcaaaagggggaggaggugcaggucauugccguagagccagggaagaacccaaagaacuuucaaaccaugccaggcacuuuccagacuacuacaggggaaauaggagcaauugcacuggauuucaagccuggaacuucaggaucuccuaucauaaauagagagggaaagguagugggacuguauggcaauggagugguuacaaagaaugguggcuaugucagcggaauagcgcaaacaaaugcagaaccagaugggccgacaccagaguuggaagaagagauguucaaaaagcgaaaccugaccauaauggaucuccauccugggucaggaaagacacggaaauaccuuccagccauugucagagaggcaaucaagagacguuuaagaaccuuaauuuuggcaccgacaagggugguagcagcugagauggaagaagcauugaaagggcucccaauaagguaccaaacaacagcaacaaaaucugaacacacaggaagagagauuguugaucuaaugugccacgcaacguucacaaugcguuugcugucaccaguuaggguuccaaauuacaacuugauaauaauggaugaggcccauuucacagacccagccagcauagcggcuagaggguacauaucaacucguguuggaaugggagaggcagccgcaaucuucaugacagcaacacccccuggaacagcugaugccuuuccucagagcaacgcuccaauucaagaugaagaaagggacauaccagaacgcucauggaauucaggcaaugaauggauuacugacuucgccgggaaaacggugugguuugucccuagcauuaaggccggaaaugacauagcaaacugcuugcgaaaaaacgggaagaaggucauucaacuuaguaggaagacuuuugacacagaauaucagaagacuaaacugaaugauugggacuuuguggugacgacugacauuucagaaaugggggccaauuucaaagcagauagagugauugacccaagaagaugccucaaaccagugaucuugacagauggaccagagcgggugauccuggccggaccaaugccagucaccgcggcgagugcugcgcaaaggagagggagaguuggcaggaacccacaaaaggaaaaugaccaguacauauucacgggccagccucucaacaaugaugaagaccaugcucacuggacagaagcaaaaaugcugcuggacaacaucaacacaccagaaggaauuuuaccagcucucuuugaaccagaaagggagaagucagccgccauagacggugaguaucgccugaagggugagucuaggaagacuuuuguggaacucaugaggaggggugaccuuccgguuugguuagcccauaaaguagcaucagaaggaauuaaauauacagauagaaaauggugcuuugaugggcaacgcaauaaucaaaucuuagaggagaacauggauguggaaaucuggacaaaggaaggagaaaagaaaaaauugagaccuagguggcuugaugcccgcacuuauucagauccauuagcacucaaggaauucaaggacuuugcggcuggcagaaagucaaucgcccuugaucuugugacagaaauaggaagagugccuucacaccuagcccacagaacaagaaacgcuuuggacaaucuggugaugcugcacacgucagaacauggcgguagggcuuacagacaugcgguggaggaacuaccagaaacaauggaaacacuccuacucuugggacuuaugaucuugcugacagguggagcaaugcuuuucuugauaucagguaaagggauuggaaagacuucaauaggacucaucuguguaauugcuuccagcggcauguuguggauggccgaaguuccacuccaauggauugcgucggcuauaguccuggaguuuuuuaugaugguguugcucauaccagaaccagaaaagcagagaaccccccaagacaaccaacuugcauaugucgugauaggcauacuuacauuggcugcaauaauagcagccaaugaaaugggacuguuggaaaccacaaagagagacuuaggaaugucuaaggagccagguguuguuucuccaaccagcuauuuggauguggacuugcacccagcaucagccuggacauuguacgccguggccacuacaguaauaacaccaauguuaagacauaccauagagaauucuacagcaaaugugucccuggcugcuauagcaaaccaggcagugguucugauggguuuggacaaaggauggccaauaucaaaaauggacuugggcgugccacuacuagcacuggguugcuauucacaagugaacccacugacucuaaccgcggcaguacuuuugcuaaucacacauuaugcuaucauagguccaggauugcaagcaaaagccacccgugaagcucagaaaaggacagcugcuggaauaaugaaaaauccaacgguggaugggauaaugacaauagaccuagauccuguaauauaugauucaaaauuugaaaaacaacuaggacaggucaugcuccugguuuugugcgcaguccaacuuuuguuaaugagaacaucaugggccuugugugaagcuuuaacucuagcuacaggaccaauaacaacacucugggaaggaucaccugguaaguuuuggaacaccacgauagcuguuuccauggcgaacauuuuuagagggagcuaucuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguucgaucuuuacaaaaaaucuggaauuacugaaguggauagaacagaagccaaagaaggguugaaaagaggagagacaacacaucaugccguguccagagguagcgcaaaacuucaaugguuuguggaaagaaacauggucguucccgaaggaagagucauagacuugggcuguggaagaggaggcuggucauauuacugugcaggacugaaaaaagucacagaagugcgaggauacacaaaaggcgguccaggacacgaagaaccaguaccuaugucuacauauggauggaacauaguuaaguuaaugagcggaaaggauguguucuaccucccaccugaaaagugugauacccuguugugugacauuggagaaucuucaccaagcccaacaguggaagagaguagaacuauaagaguuuugaagaugguugaaccauggcuaaaaaacaaccaguuuugcauuaaaguuuugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaacauggugucuagauuguuacugaacagguucacgaugacacacaggagacccaccauagagaaagauguggauuuaggagcaggaacccgacauguuaaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuucucacuaaaccaugggauguggugcccauggugacacagauggcaaugacagacacaacuccauuuggccagcagagagucuuuaaagagaaaguggacaccaggacgcccaggcccaugccagggacaagaaagguuauggaaaucacagcggaguggcucuggagaacccugggaaggaacaaaagacccagguuaugcacaagggaagaguucacaaaaaaggucagaacuaacgcagccaugggcgcuguuuucacagaggagaaccaaugggacagugcgaaagcugcuguugaggaugaagaauuuuggaaacuuguggacagagaacgugaacuccacaaauugggcaaauguggaagcugcguuuauaacaugauggguaagagagagaaaaaacuuggagaguuuggcaaagcaaaaggcaguagagcuauaugguacaugugguugggagccagguaccuugaguucgaagcccuuggauucuuaaaugaagaccacugguucucacgugaaaacucuuacaguggaguagaaggagaaggacugcacaagcuaggcuauauauuaagggacauuuccaagauacccggaggagccauguaugcagaugacacagcugguugggacacaagaauaacagaagaugaccugcacaaugaggaaaagaucauacagcaaauggacccugaacacaggcaguuagcgaacgcuauauucaagcucacauaccaaaacaaagugguuaaaguucaacgaccgacuccaacggguacgguaauggacauuauaucuaggaaagaccaaaggggcaguggacaagugggaacuuauggcuugaacacauucaccaacauggaagcccaguuagucagacaaauggaaggagaaggugugcugacaaaggcagaccucgagaacucucaucugccagagaagaaaauuacacaaugguuggaaaccaaaggaguggagagguuaaaaagaauggccauuagcggagaugauugcguggugaaaccaaucgaugauagguucgcuaaugcucugguugcccugaacgauaugggaaagguucggaaagacauaccucaauggcagccaucaaggggauggcaugauuggcaacaggucccuuucugcucccaccacuuucaugaauugaucaugaaagauggaagaaaguuagugguucccugcagaccacaggacgaacuaauaggaagagcaagaaucucucaaggagcgggauggagccuuagagaaacugcaugucuggggaaagccuacgcccaaauguggagucucauguauuuucacagaagagaucucagauuagcauccaacgccauaugcucagcaguaccaguccacuggguucccacaaguagaacgacauggucuauucaugcucaccaucaguggaugacuacagaagacaugcuuacuguuuggaacaggguguggauagaggaaaauccauggauggaagacaaaacuccaguuacaacuugggaaaauguuccauaucuagggaagagagaagaccaaugguguggaucacuuauuggucucacuuccagagcaaccugggcccagaacauacccacagcaauucaacaggugagaagccuuauaggcaaugaagaguucuuggacuauaugccuucaaugaagagguucaggaaggaagaggagucggagggggccauuugguaa

SEQ ID NO: 7713 - RNA, 9873 nt, Artificial Sequence
  derived and/or modified CDS sequence (wt) from DENV-3__KC762681__SS-prME
acaucgcucugccucaugaugauguuaccagcaacacuugcuuuccacuugacuucacgagauggagagccgcgcaugauuguggggaagaaugaaagagggaaaucccuucucuucaagacagccucuggaauuaauaugugcacacucauagccauggauuugggagagaugugugaugacacggucacuuacaaaugcccccuuaucacugaaguggagccugaggacauugacugcuggugcaaccucacaucgacgugggugaccuacggaacgugcaaccaagcuggagagcauagacgcgauaagagaucgguggcguuagcuccccaugucggcaugggacuggacacacgcacccaaaccuggaugucggcugaaggagcuuggagacaaguugagaagguagagacaugggcuuuuaggcacccaggguucacaauacuagcccuauuucuugcccauuacauaggcacuuccuugacccagaaaguggucauuuucauacuacugaugcuggucaccccauccaugacaaugagaugugugggaguaggaaacagagacuucguggaaggccuaucaggagcuacguggguugauguggugcucgagcacggugggugugugacuaccauggcuaagaacaagcccacgcuagauauagagcuccagaagaccgaggccacccaacuggcgacccuaaggaaacuauguauugaggggaaaaucaccaacguaacaaccgacucaaggugccccacccaaggggaagcgauuuuaccugaggaacaggaccagaacuacguguguaagcacacauacguggacagaggcugggggaacgguugugguuuguuuggcaagggaagcuugguaacaugcgcgaaguuucaauguuuggaauuuauagagggaaaaguggugcagcaugagaaccucaaauacacugucaucaucacagugcacacaggagaccaacaucaggugggaaaugaaacccagggagucacggcugagauaacaccucaggcaucaaccgucgaagccaucuuaccugaauauggaacccuugggcuagaaugcucaccacggacagguuuggauuuuaaugaaaugauuuuguugacaaugaagaacaaagcauggaugguacauagacagugguuuuuugaccuaccucuaccauggacaucaggggccacaacagaaacaccaaccuggaacaagaaagagcuucuugugacauuuaaaaaugcacacgcaaagaaacaagaaguaguaguucuuggaucgcaagagggagcaaugcacacagcacugacaggagccacagagauccaaaccucaggaggcacaaguauuuuugcggggcauuuaaagugcagacucaagauggacaaauuggaacucaaggggaugagcuaugcaaugugcuuaaaugccuuuguguugaagaaagaagucuccgaaacacaacaugggacaauacucauuaagguugaguacaaaggagaagaugcaccuugcaagauuccuuucuccacggaggauggacagggaaaagcccacaauggcagacugaucacagcuaacccaguggugaccaagaaggaggagccugucaauauugaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucuccuggauaaugaaaauuggaauaggcguccuuuuaaccuggauaggguugaauucaaaaaacacuucuaugucauuuucaugcauugugauaggaaucaucacacucuaucugggagccguggugcaagcugacauggggugugucauaaacuggaaaggcaaagaacucaaauguggaagcgggauuuucguuaccaaugagguccacaccuggacagagcaauacaaauuucaagcagacuccccuaagagacuggcaacagccauugcaggcgccugggaaaauggagugugcggaaucaggucgacaaccagaauggagaaccuuuuguggaagcaaauagccaaugaacugaacuacauauuaugggaaaacaacaucaaauugacgguaguugugggugauauaauuggggucuuagagcaagggaaaagaacacugacaccacaacccauggaucuaaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuccgagagauguacacucaacuaugcgaccacaggcuaaugucggcagccguuaaggaugagagagccguacacgccgacaugggcuauuggauagaaagccaaaagaauggaaguuggaaacuagaaaaggcaucccucauagaggugaaaaccugcacauggccaaaaucacacacucucuggagcaauggcgugcuggagagugacaugaucaucccaaagagucuggcugguccuguuucgcaacacaacuacaggcccggauaucacacccaaacggcaggaccuuggcaccuaggaaaauuggagcuggauuucaacuauugugaaggaacaacaguugucaucacagaaaauugugggacaagaggcccaucacugaggacaacaacagugucagggaaguugauacacgaaugguguugccgcucauguacacuuccuccccugcgauacaugggagaagacggcuguugguauggcauggaaauuagacccauuaaugagaaagaagagaacaugguaaagucuuuagucucagcagggaguggaaagguggauaacuucacaauggguguuuuauguuuggcaauccucuuugaagaggugaugagaggaaaauucggaaaaaagcacaugauugcagggguucucuuuacauuugugcuccuucucucagggcagauaacauggagagauauggcgcgcacacucauaaugauuggguccaacgccucugacagaaugggaaugggcgucacuuacuuagcauugauugcaacauuuaaaauucagccauuuuuggcuuugggauucuuccugaggaaacugacaucuagagaaaauuuauuguugggaguugggcuggccauggcaacaacguuacaacugccagaggacauugaacaaauggcgaauggaauagcuuuggggcucauggcucucaaauugauaacacaauuugaaacauaucaacuauggacggcauuaguuucccuaauguguucaaacacaauguucacguugacuguugccuggagaacagccacccugauuuuggccggaauuucgcuuuugccagugugccagucuucgagcaugaggaaaacagauuggcuuccaguuacuguggcagccaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccauugguggcugggggcuugcugauagcgugcuacguuauaacuggcacgucagcagaccucacuguagaaaaagcagcagaugugauaugggaggaagaggcugagcaaacaggagugucccacaauuuaaugaucacaguugaugaugauggaacaaugagaauaaaagaugaugagacugagaacauccuaacagugcuauugaaaacagcauuacuaauagugucaggcauuuuuccauacuccauacccgcuacacuguuggucuggcacacuuggcaaaagcaaacccaaagauccggcguccuaugggacgugcccagccccccagagacacagaaagcagaacuggaagaagggguuuauaggaucaagcagcaaggaauuuuugggaagacccaaguggggguuggaguacaaaaagaaggaguuuuccacaccauguggcacgucacaagaggagcagugcugacacacaacgggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuccaaaccaugccaggcauuuuccagacaacaacaggagagauaggagcgauugcacuggacuucaagccugggacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaagaagcgaaaucuaaccauaauggaucuccaucccgggucaggaaagacgcggaaauaccucccagcuauuguuagagaagcaaucaaaagacgcuuaaggacucuaauuuuggcaccaacaaggguggucgcagcugagauggaagaagcauugaaagggcucccaauaagguaccaaacaacugcaacaaaaucugcacacacagggaaagagauuguugaucuaaugugucacgcaacauucacaaugcguuuauugucaccagucagaguuccaaacuauaacuugauaauaauggaugaggcucauuuuacagacccagcuagcauagcggcuagaggguacauaucaacucguguaggaaugggagaggcagcugcaauuuucaugacagccacgcccccuggcacagcugaugccuuuccucagagcaaugccccaauucaagaugaagaaagagacauaccagaacgcucauggaauucagguaaugaauggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaagacuaaacuaaaugauugggacuuuguggugacaacagacauuucagaaaugggagccaauuucaaaacagacagagugaucgacccaagaagaugucucaagccagucauuuugacagacggacccgagcgcgugauccuggcgggaccaaugccagucaccguagcgagcgccgcgcaaaggagagggagaguuggcaggaacccacaaaaggaaaaugaccaauacauauucacgggccagccccucaauaaugaugaagaccacgcucacuggacagaagcaaaaaugcugcuagacaacaucaacacaccagaagggauuauaccagcucucuuugaaccagaaagggagaagucagccgccauagacggcgaauaccgccugaaaggugaauccaggaagaccuucguggaacucaugaggaggggugaccucccaguuuggcuagcccauaaaguagcaucagaaggaaucaaauauacagacagaaaauggugcuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcucuugaucuugugacagaaauaggaagagugccuucacaccuagcccacagaacgagaaacgcucuggacaaucuggugauguugcacacgucagaacauggugggagggcuuacaggcaugcaguggaggaauuaccagaaacaauggaaacacucuuacuccugggacucaugauccuguuaacagguggggcaaugcuuuucuugauaucagguaaagggauuggaaagacuucaauaggacucauuuguguaguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacauuggcugcaauaguggcagccaaugaaaugggauuguuggaaaccacaaagagagauuuaggaauguccaaagaaccagguguuguuucuccaacuagcuauuuggauguggauuugcacccagcaucagccuggacauuguacgcuguggccacaacaguaauaacaccaauguugagacacaccauagagaacuccacagcaaaugugucccuggcagcuauagccaaccaggcagugguccugauggguuuagacaaaggauggccgauaucaaaaauggacuuaggcguaccacuauuggcacuggguugcuauucgcaagugaacccacuaacucucacagcggcaguacuccugcuagucacgcauuacgccauuauagguccaggauugcaggcaaaagccacucgugaagcccaaaaaaggacagcugcuggaauaaugaagaauccaacgguggaugggauaaugacaauagaccuagauccuguaauauacgauucaaaauuugaaaagcaacuaggacagguuaugcuccugguucugugugcaguucaacuuuuguuaaugagaacauccugggcauuuugugaagcucuaacccuagccacaggaccaauaacaacacucugggaagggucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuugggagaaaaguggaaaaagaaauugaaucaauuaucucggaaagaauuugaccuuuacaagaaauccggaaucacugaaguggauagaacagaagccaaagaaggguugaaaagaggagaaauaacacaccaugccguauccagaggcagcgcgaaacuucaaugguucguggagagaaauauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaauauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaauaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaaguuaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacaccaggacaccuagacccaugccaggaacaagaaaggcuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucgcgugaaaacucuuucaguggaguagaaggggaaggacugcauaaacugggauacaucuugagagacauuuccaagauacccggaggagcuauguaugcugaugacacagcugguugggacacaagaauaacagaagaugaccugcauaacgaggaaaaaaucacgcagcaaauggacccugaacacaggcaauuagcaaacgccauauuuaagcucacauaccaaaacaaaguggucaagguucaacgaccaacuccaaagggcacggugauggacaucauaucuaggaaagaccaaagaggcagcggacaggugggaacuuauggucugaauacauucaccaacauggaaguucaguuaaucagacaaauggaaggagaaggugugcugucgaaggcagaccucgagaacccucaucugcuagagaaggaaauuacacaaugguuggaaacuaaaggaguggagagguuaaaaagaauggccaucagcggggaugauugcguggugaaaccaaucgaugacagguucgccgaugcccugcuugcccugaaugacauggggaaaguuaggaaggacauaccucaauggcagccaucgaagggauggcaugauuggcaacagguuccuuucugcucccaccacuuucaugaauugaucaugaaagauggaagaaaguugguaguccccugcagaccucaggaugaauuaauagggagagcgagaauuucucaaggagcaggauggagccuuaaagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaucaguggaugacuacagaggacaugcuuacuguuuggaacaggguguggauagaggacaauccauggauggaagauaaaacuccaguuacaacuugggaagauguuccauaucuagggaagagagaagaccaauggugcggaucacucauuggucuugcuuccagagcaaccugggcccaaaacauacuuaccgcaauccaacagguaagaagccuuauaggcaaugaagaguuucuggacuacaugccuucgaugaagagauucaggaaggaggaggagucagagggagccauuugguaa

SEQ ID NO: 7714 - RNA, 9873 nt, Artificial Sequence
  derived and/or modified CDS sequence (wt) from DENV-3__KC762684__SS-prME
acaucgcucugucucaugaugauguuaccagcaacacuugcuuuccacuugacuucacgagauggagagccgcgcaugauuguagggaagaaugaaagaggaaaaucccuacuuuuuaagacagccucuggaaucaacaugugcacacucauagccauggauuugggagaaaugugugaugacacggucacuuacaaaugcccccuuauuacugaaguggagccugaagacauugacugcuggugcaaucucacaucgacgugggugaccuacggaacgugcaaccaagcuggagagcauagacgcgauaagagaucgguggcguuagcuccucaugucggcaugggacuggacacacgcgcccaaaccuggaugucggcugaaggagcuuggagacaaguugagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuaccauggccaagaacaagcccacgcuggacauagagcuccagaagaccgaggccacccaacuggcaacccuaaggaaacuaugcauugagggaaaaaucaccaacgugacaaccgacucaaggugccccacccaaggggaagcaauucuaccugaggagcaggaccagaacuacguguguaagcacacauacguggacagaggcuggggaaacgguugugguuuguuuggcaagggaagcuugguaacaugcgcaaaauuucaauguuuggaauuaauagagggaaaaguggugcagcaugagaaccuuaaauacaccgucagcaucacagugcacacaggagaccaacaccaggugggaaaugaaacacagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacaaugguuuuuugaccuaccucuaccauggacaucaggggcuacaacagaaacaccaaccuggaacaagaaagagcuucuugugacauucaaaaacgcacacgcaaaaaaacaagaaguaguaguccuuggaucgcaagagggagcaaugcacacagcacuaacaggagcuacagagauccaaaccucaggaggcacaagcauuuuugcggggcacuugaaaugcagacucaagauggacaaauuggaacucaaggggaugagcuaugcaaugugcucaaaugccuuuguguugaagaaagaagucucugaaacacagcaugggacaauacucauuaagguugaguacaaaggggaagacgcaccuugcaagauucccuucuccacggaggauggacaagggaaagcccacaauggcagacugaucacagccaacccaguggugaccaagaaggaggagccugucaauauugaggcagaaccuccuuucggggaaaguaacauaauaauuggaauuggagacaaagcccugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauucggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaacuggaaaggcaaagaacucaaguguggaaguggaauuuucguuacuaaugagguccacaccuggacagagcaauacaaauuucaagcagacucccccaaaagacuggcgacagccauugcaggcgccugggagaauggagugugcggaaucaggucgacaaccagaauggagaaccucuuguggaagcagauagccaaugaacuaaacuacauauuaugggaaaacaacaucaaauuaacgguaguugugggugauauaauugggaucuuagagcaagggaaaagaacacuaacaccacaacccauggagcuaaaauauucauggaaaacauggggaaaggcgaaaauagugacagcugaaaugcaaaauuccuccuuuauaauagaugggccaaacacaccagaguguccaaaugccucaagagcauggaaugugugggagguggaagacuacggguucggagucuucacaacuaauauauggcugaaacuccgggaaauguacacccaacuaugugaucacaggcuaaugucggcagccauuaaggaugagagagccguacacgccgacaugggcuauuggauagaaagccaaaagaauggcaguuggaaacuagaaaaggcaucucucauagaggugaaaaccugcacauggccaaaaucacacacucucuggagcaaugguguguuggagagugacaugaucaucccaaagagucuggcuggucccaucucgcaacacaauuacaggcccggauaccacacccaaacggcaggaccauggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauacaugggagaagacggcugcugguauggcauggaaauuagacccauuaaugagagagaagagaacaugguaaagucuuuagucucagcagggaguggaaagguggauaacuucacaaugggugucuugugucuugcaauccucuuugaagagguaaugaggggaaaauucgggaaaaagcacaugauugcagggguuuucuucacauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuucuugaggaaacugacaucuagagaaaauuuauuauugggaguuggguuggccauggcaacaacguugcaacugccagaggacauugaacaaauggcgaauggaauagcccuggggcucauggcucuuaaauugguaacacaauuugaaacauaccaacuauggacagcauuagucucccuaauguguucaaacacaauuuucacguugacuguugccuggagaacagccacccugauuuuggccggaauuucgcuuuugccacugugccagucuucgggcaugaggaaaacagauuggcucccaaugacuguggcagcuaugggaguuccaccucuaccacucuuuauuuucaguuugaaagacacacucaaaaggagaagcuggccacugaaugagggggugauggccguuggacuugugagcauucuagcaaguucucuucuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuacaggaucaagcagcaaggaauuuuuggaaagacccaagugggaguuggaguacaaaaagaaggaguuuuccacaccauguggcacgucacaagaggagcaguguugacauacaauggaaaaagacuggaaccaaacugggcuagcgugaaaaaagaucugauuucauacggaggaggauggagacugagugcacaauggcaaaaaggagaagaggugcagguuaucgccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaagcgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacccuaauuuuggcaccaacaaggguggucgcagcugagauggaagaagcauugaaagggcuuccaauaagguaucaaacaacugcaacaaaaucugaacauacagggaaagagauuguugaucuaaugugucacgcaacguucacaaugcguuugcugucaccagucagaguuccaaacuacaaccugauaauaauggaugaggcucauuucacagacccagccaguauagcggcuagaggguacauaucaacucguguaggaaugggagaggcagccgcaaucuucaugacagccacaccuccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcugggaaugacauagcaaacugcuugcggaaaaauggaaaaaaggucauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauuuacgggccagccucucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguggcaucagaaggaaucaaauacacagacagaaaaugguguuuugauggagagcgcaacaaccaaauuuuagaggagaauauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcucacagaacgagaaacgcucuggacaaucuggugauguugcacacgucagaacacggugggagggccuacaggcaugcaguggaggaauuaccagaaacaauggaaacacuucuacuccugggacuuaugauccuguuaacagguggggugaugcuuuucuugauaucaggcaaagggguuggaaagacuucaauaggacucauuuguguaguugcuuccagcagcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaacgaaaugggauuguuggaaaccacaaagagagauuuggggauguccaaagaaccagguguuguuucgccaaccagcuauuuggauguggauuugcacccagcaucagccuggacacuguaugcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacuggguugcuauucacaagugaacccacuaacucucacagcggcagugcuccugcuagucacgcauuaugcuauuauagguccaggauugcaagcaaaagccacucgugaagcucaaaaaaggacggcagcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaauacuacgauagcuguuuccauggcgaacaucuuuagggggagcuauuuagcaggagcuggacuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguuaaaaagaggagaaauaacacaccaugccguaucuagaggcagcgcaaaacuucaaugguucguggagagaaacauggucauuccugaaggaagagucauagacuugggcuguggaagaggaggcuggucauauuauugugcaggauugaaaaaaguuacagaagugcgaggauacacaaaaggcggcccaggacaugaagaaccaguaccuauguccacauauggauggaacauagucaagcugaugaguggaaaggauguguuuuaucuuccaccugaaaagugugacacucuauuaugugacauuggagaaucuucaccaaguccaacaguggaggagagcagaaccauaagagucuugaaaauggucgaaccauggcuaaaaaauaaccaguuuugcauuaaaguauugaacccuuacaugccagcugugauugagcaccuagaaagacuacaaaggaaacauggaggaaugcuugugagaaauccacucucacgaaauuccacgcacgaaauguacuggauauccaauggcacaggcaacaucgucucuucggucaacaugguauccagacugcuacugaacagauucacgaugacauauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagcuuccuccaugauaaauggagucgugaaacuccucacgaaaccaugggauguggugcccacggugacacagauggcaaugacagacacgaccccuuuuggccagcaaaggguuuuuaaagagaaaguggacaccaggacacccaaacccaugccaggaacaagaaagguuauggagaucacagcggaauggcuuuggagaacccugggaaggaacaaaagaccaagauuaugcacgagagaggaguucacaaagaaggucagaaccaacgcagcuaugggcgccguguucacagaggagaaccaaugggacagugcuagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaaugaggaaaaaaucacacagcaaauggaccccgaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguagagagguuaaaaagaauggccaucagcggggaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugccuaggaaaagccuacgcccaaaugugggcucucauguauuuucacagaagagaucuuagacuagcauccaaugccauauguucagcaguaccaguccauuggguccccacaagcagaacgacgugguccauccaugcucaccaucaguggaugacuacagaagacaugcuuacuguuuggaauaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7715 - RNA, 9873 nt, Artificial Sequence
  derived and/or modified CDS sequence (wt) from DENV-3__KC762686__SS-prME
acaucgcucugccucaugaugauguuaccagcaacacuugcuuuccaccugacuucacgagauggagagccgcgcaugauuguggggaagaaugaaagagggaaaucccuucucuucaagacagccucuggaauuaauaugugcacacucauagccauggauuugggagagaugugugaugacacggucacuuacaaaugcccccuuaucacugaaguggagccugaggacauugacugcuggugcaaccucacaucgacgugggugaccuacggaacgugcaaccaagcuggagagcauagacgcgauaagagaucgguggcguuagcuccccaugucggcaugggacuggacacacgcgcccaaaccuggaugucggcugaaggagcuuggagacaaguugagaagguagagacaugggcuuuuaggcacccaggguucacaauacuagcccuauuucuugcccauuacauaggcacuuccuugacccagaaaguggucauuuucauacuacugaugcuggucaccccauccaugacaaugagaugugugggaguaggaaacagagauuucguggaaggccuaucaggagcuacguggguugacguggugcucgagcacggugggugugugacuaccauggcuaagaacaagcccacgcuagauauagagcuccagaagaccgaggccacccaacuggcgacccuaaggaaacuauguauugaggggaaaaucaccaacguaacaaccgacucaaggugccccacccaaggggaagcgauuuuacccgaggaacaggaccagaacuacguguguaagcacacauacguggacagaggcugggggaacgguugugguuuguuuggcaagggaagcuugguaacaugcgcgaaguuucaauguuuggaauuuauagagggaaaaguggugcagcaugagaaccucaaauacaccgucaucaucacagugcacacaggagaccaacaucaggugggaaaugaaacgcagggagucacggcugagauaacaccucaggcaucaaccgucgaagccaucuuaccugaauauggaacccuugggcuagaaugcucaccacggacagguuuggauuucaaugaaaugauuuuguugacaaugaagaacaaagcauggaugguacauagacagugguuuuucgaccuaccucuaccauggacaucaggggccacaacagaaacaccaaccuggaacaagaaagagcuucuugugacauuuaaaaaugcacacgcaaagaaacaagaaguaguaguccuuggaucgcaagagggagcaaugcacacagcacugacaggagccacagagauccaaaccucaggaggcacaaguauuuuugcggggcauuuaaagugcagacucaagauggacaaauuggaacucaaggggaugagcuaugcaaugugcuuaaaugccuuuguguugaagaaagaagucuccgaaacacaacaugggacaauacucauuaagguugaguacaaaggggaagaugcaccuugcaagauuccuuucuccacggaggauggacagggaaaagcccacaauggcagacugaucacagcuaacccaguggugaccaagaaggaggagccuaucaauauugaggcagaaccuccuuuuggggaaaguaacauaguaauuggaauuggagacaaagcuuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucucuuggauaaugaaaauuggaauaggcguccuuuuaaccuggauaggguugaauucaaaaaacacuucuaugucauuuucaugcauugugauagggaucaucacacucuaucugggagccguggugcaagcugacauggggugugucauaaacuggaaaggcaaagaacucaaauguggaagcgggauuuucguuaccaaugagguccacaccuggacagagcaauacaaauuucaagcagacuccccuaagagacuggcaacaaccauugcaggcgccugggaaaauggagugugcggaaucaggucgacaaccagaauggagaaccuuuuguggaagcaaauagccaaugaacugaacuacauauuaugggaaaacaacaucaaauugacgguaguugugggugauauaauuggggucuuagagcaagggaaaagaacacugacaccacaacccauggagcugaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuccgagagauguacacccaacuaugugaccacaggcuaaugucggcagcuguuaaggaugagagagccguacacgccgacaugggcuauuggauagagagccaaaagaauggaaguuggaaacuagaaaaggcaucccucauagaggugaaaaccugcacauggccaaaaucacacacucucuggagcaauggcgugcuggagagugacaugaucaucccaaagagucuggcugguccuguuucgcaacacaaccacaggcccggauaucacacccaaacggcaggaccuuggcaccuaggaaaauuggagcuggauuucaacuauugugaaggaacgacaguugucaucacagaaaauugugggacaagaggcccaucacugaggacaacaacagugucagggaaguugauacacgaaugguguugccgcucauguacacuuccuccccugcgauacaugggagaagacggcuguugguauggcauggaaauuagacccauuaaugagaaagaagagaacaugguaaagucuuuagucucagcagggaguggaaagguggauaacuucacaauggguguuuuaugucuggcaauccucuuugaagaggugaugagaggaaaauucggaaaaaagcacaugauugcagggguucucuuuacauuugugcuccuucucucagggcagauaacauggagagauauggcgcgcacacucauaaugauuggguccaacgccucugacagaaugggaaugggcgucacuuaccuagcauugauugcaacauuuaaaauucagccauuuuuggcuuugggauucuuccugaggaaacugacuucuagagaaaauuuauuguugggaguugggcuggccauggcaacaacguuacaacugccagaggacauugaacaaauggcgaauggaauagcuuuggggcucauggcucucaaauugauaacacaauuugaaacauaucaacuauggacggcauuaguuucccuaauguguucaaacacaauuuucacguugacuguugccuggagaacagccacccugauuuuggccggaauuucgcuuuugccagugugccagucuucgagcaugaggaaaacagauuggcucccaguuacuguggcagccaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccauuaguggcugggggcuugcugauagcgugcuacguuauaacuggcacgucagcagaccucacuguagaaaaagcagcagaugugauaugggaggaagaggcugagcagacaggagugucccacaauuuaaugaucacaguugaugaugauggaacaaugagaauaaaagaugaugagacugagaacauccuaacagugcuauugaaaacagcauuacuaauagugucaggcauuuuuccauacuccauacccgcuacacuguuggucuggcacacuuggcaaaagcaaacccaaagauccggcguccuaugggacguacccagccccccagagacacagaaagcagaacuggaagaaggggucuauaggauuaagcagcaaggaauuuuugggaagacccaaguggggguuggaguacaaaaagaaggaguuuuccacaccauguggcacgucacaagaggagcagugcugacacacaacgggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuccaaaccaugccaggcauuuuccagacaacaacaggagagauaggagcgauugcacuggacuuuaagccugggacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaagaagcggaaucuaaccauaauggaucuccaucccgggucaggaaagacgcggaaauaccucccagcuauuguuagagaagcaaucaaaagacgcuuaaggacucuaauuuuggcaccaacaaggguggucgcagcugagauggaagaagcauugaaggggcucccaauaagguaucaaacaacugcaacaaaaucugcacacacagggaaagagauuguugaucuaaugugucacgcaacauucacaaugcguuuacugucaccagucagaguuccaaacuauaacuugauaauaauggaugaggcucauuuuacagacccagcuagcauagcggcuagaggguacauaucaacucguguaggaaugggagaggcagccgcaauuuucaugacagccacgcccccuggcacagcugaugccuuuccucagagcaaugccccaauucaagaugaagaaagagacauaccagaacgcucauggaauucagguaaugaauggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagcgccgcgcaaaggagagggagaguuggcaggaacccacaaaaggaaaaugaccaauacauauucacgggccagccccucaauaaugaugaagaccacgcucacuggacagaagcaaaaaugcugcuagacaacaucaacacaccagaagggauuauaccagcucucuuugaaccagaaagggagaagucagcugccauagacggcgaauaccgccugaaaggugaauccaggaagaccuucguggaacucaugaggaggggugaccucccaguuuggcuagcccauaaaguagcaucagaaggaaucaaauauacagacagaaaauggugcuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcucuugaucuugugacagaaauaggaagagugccuucacaccuagcccacagaacgagaaacgcucuggacaaucuggugauguugcacacgucagaacauggugggagggcuuacaggcaugccguggaggaauuaccagaaacaauggaaacacucuuacuccugggacucaugauccuguuaacagguggggcaaugcuuuucuugauaucagguaaagggauuggaaagacuucaauaggacucauuugugugguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacauuggcugcaauaguggcagccaaugaaaugggauuguuggaaaccacaaagagagauuuaggaauguccaaagaaccagguguuguuucuccaacuagcuauuuggauguggaucugcacccagcaucagccuggacauuguacgcuguggccacaacaguaauaacaccaauguugagacacaccauagagaauuccacagcaaaugugucccuggcagcuauagccaaccaggcagugguccugauggguuuagacaaaggauggccgauaucgaaaauggacuuaggcguaccacuauuggcacuggguuguuauucgcaagugaacccacuaacucucacagcggcaguacuccugcuagucacgcauuacgccauuauagguccaggauugcaggcaaaagccacucgugaagcccaaaaaaggacagcugcuggaauaaugaagaauccaacgguggaugggauaaugacaauagaccuagauccuguaauauacgauucaaaauuugaaaagcaacuaggacagguuaugcuccugguucugugugcaguucaacuuuuguuaaugagaacauccugggcauuuugugaagcucuaacccuagccacaggaccaauaacaacacucugggaagggucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuugggagaaaaguggaaaaagaaauugaaucaauuaucucggaaagaauuugaccuuuacaagaaauccggaaucacugaaguggauagaacagaagccaaagaaggguugaaaagaggagaaauaacacaccaugccguauccagaggcagcgcgaaacuucaaugguucguggagagaaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaaguuaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacacuaggacaccuagacccaugccaggaacaagaaaggcuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucgcgugaaaacucuuucaguggaguagaaggggaaggacugcauaaacugggauacaucuugagagacauuuccaagauaccaggaggagcuauguaugcugaugacacagcugguugggacacaagaauaacagaagaugaccugcauaacgaggaaaaaaucacgcagcaaauggagccugaacacaggcaauuagcaaacgccauauuuaagcucacauaccaaaacaaaguggucaagguucaacgaccaacuccaaagggcacggugauggacaucauaucuaggaaagaccaaagaggcagcggacaggugggaacuuauggucugaacacauuuaccaacauggaaguucaguuaaucagacaaauggaaggagaaggugugcugucgaaggcagaccucgagaacccucaucugcuagagaaggaaauuacacaaugguuggaaacuaaaggaguggagagguuaaaaagaauggccaucagcggggaugauugcguggugaaaccaaucgaugacagguucgccgaugcccugcuugcccugaaugacauggggaaaguuaggaaggacauaccucaauggcagccaucgaagggauggcaugauuggcaacagguuccuuucugcucccaccacuuucaugaauugaucaugaaagauggaagaaaguugguaguccccugcagaccucaggaugaauuaauagggagagcgagaauuucucaaggagcaggauggagccuuaaagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaucaguggaugaccacagaggacaugcuuacuguuuggaacaggguguggauagaggacaauccauggauggaagauaaaacuccagucacaacuugggaagauguuccauaucuagggaagagagaagaccaauggugcggaucacucauuggucuugcuuccagagcaaccugggcccaaaacauacuuaccgcaauccaacagguaagaagccuuauaggcaaugaagaguuucuggacuacaugccuucgaugaagagauucaggaaggaggaggagucagagggagccauuugguaa

SEQ ID NO: 7716 - RNA, 9873 nt, Artificial Sequence
  derived and/or modified CDS sequence (wt) from DENV-3__KC762685__SS-prME
acaucgcucugccucaugaugauguuaccagcaacacuugcuuuccaccugacuucacgagauggagagccgcgcaugauuguggggaagaaugaaagagggaaaucccuucucuucaagacagccucuggaauuaacaugugcacacucauagccauggauuugggagagaugugugaugacacggucacuuacaaaugcccccuuaucacugaaguggagccugaggacauugacugcuggugcaaccucacaucgacgugggugaccuacggaacgugcaaccaagcuggagagcauagacgcgauaagagaucgguggcguuagcuccccaugucggcaugggacuggacacacgcgcccaaaccuggaugucggcugaaggagcuuggagacaaguugagaagguagagacaugggcuuuuaggcacccaggguucacaauacuagcccuauuucuugcccauuacauaggcacuuccuugacccagaaaguggucauuuucauacuacugaugcuggucaccccauccaugacaaugagaugugugggaguaggaaacagagauuucguggaaggccuaucaggagcuacguggguugacguggugcucgagcacggugggugugugacuaccauggcuaagaacaagcccacgcuagauauagagcuccagaagaccgaggccacucaacuggcgacccuaaggaaacuauguauugaggggaaaaucaccaacguaacaaccgacucaaggugccccacccaaggggaagcgauuuuaccugaggaacaggaccagaacuacguguguaagcacacauacguggacagaggcugggggaacgguugugguuuguuuggcaagggaagcuugguaacaugcacgaaguuucaauguuuggaauuuauagagggaaaaguggugcagcaugagaaccucaaauacaccgucaucaucacagugcacacaggagaccaacaucaggugggaaaugaaacgcagggagucacggcugagauaacaccucaggcaucaaccgucgaagccaucuuaccugaauauggaacccuugggcuagaaugcucaccacggacagguuuggauuucaaugaaaugauuuuguugacaaugaagaacaaagcauggaugguacauagacagugguuuuucgaccuaccucuaccauggacaucaggggccacaacagaaacaccaaccuggaacaagaaagagcuucuugugacauuuaaaaaugcacacgcaaagaaacaagaaguaguaguccuuggaucgcaagagggagcaaugcacacagcacugacaggagccacagagauccaaaccucaggaggcacaaguauuuuugcggggcauuuaaagugcagacucaagauggacaaauuggaacucaaggggaugagcuaugcaaugugcuuaaaugccuuuguguugaagaaagaagucuccgaaacacaacaugggacaauacucauuaagguugaguacaaaggggaagaugcaccuugcaagauuccuuucuccacggaggauggacagggaaaagcccacaauggcagacugaucacagcuaacccaguggugaccaagaaggaggagccugucaauauugaggcagaaccuccuuuuggggaaaguaacauaguaauuggaauuggagacaaagcuuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucucuuggauaaugaaaauuggaauaggcguccuuuuaaccuggauaggguugaauucaaaaaacacuucuaugucauuuucaugcauugugauagggaucaucacacucuaucugggagccguggugcaagcugacauggggugugucauaaacuggaaaggcaaagaacucaaauguggaagcgggauuuucguuaccaaugagguccacaccuggacagagcaauacaaauuucaagcagacuccccuaagagacuggcaacagccauugcaggcgccugggaaaauggagugugcggaaucaggucgacaaccagaauggagaaccuuuuguggaagcaaauagccaaugaacugaacuacauauuaugggaaaacaacaucaaauugacgguaguugugggugauauaauuggggucuuagagcaagggaaaagaacacugacaccacaacccauggagcugaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuucgagagauguacacccaacuaugugaccacaggcuaaugucggcagccguuaaggaugagagagccguacacgccgacaugggcuauuggauagaaagccaaaagaauggaaguuggaaacuagaaaaggcaucccucauagaggugaaaaccugcacauggccaaaaucacacacucucuggagcaauggcgugcuggagagugacaugaucaucccaaagagucuggcugguccuguuucgcaacacaacuacaggcccggauaucacacccaaacggcaggaccuuggcaccuaggaaaauuggagcuggauuucaacuauugugaaggaacgacaguugucaucacagaaaauugugggacaagaggcccaucacugaggacaacaacagugucagggaaguugauacacgaaugguguugccgcucauguacacuuccuccccugcgauacaugggagaagacggcuguugguauggcauggaaauuagacccauuaaugagaaagaagagaacaugguaaagucuuuagucucagcagggaguggaaagguggauaacuucacaauggguguuuuaugucuggcaauccucuuugaagaggugaugagaggaaaauucggaaaaaagcacaugauugcagggguucucuuuacauuugugcuccuucucucagggcagauaacauggagagauauggcgcgcacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguugggcuggccauggcaacaacguuacaacugccagaggacauugaacaaauggcgaauggaauagcuuuggggcucauggcucucaaauugauaacacaauuugaaacauaucaacuauggacggcauuaguuucccuaauguguucaaacacaauuuucacguugacuguugccuggagaacagccacccugauuuuggccggaauuucgcuuuugccagugugccagucuucgagcaugaggaaaacagauuggcucccaguuacuguggcagccaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccauuaguggcugggggcuugcugauagcgugcuacguuauaacuggcacgucagcagaccucacuguagaaaaagcagcagaugugauaugggaggaagaggcugagcagacaggagugucccacaauuuaaugaucacaguugaugaugauggaacaaugagaauaaaagaugaugagacugagaacauccuaacagugcuauugaaaacagcauuacuaauagugucaggcauuuuuccauacuccauacccgcuacacuguuggucuggcacacuuggcaaaagcaaacccaaagauccggcguccuaugggacguucccagccccccagagacacagaaagcagaacuggaagaaggggucuauaggauuaagcagcaaggaauuuuugggaagacccaaguggggguuggaguacaaaaagaaggaguuuuccacaccauguggcacgucacaagaggagcagugcugacacacaacgggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuccaaaccaugccaggcauuuuccagacaacaacaggagagauaggagcgauugcacuggacuuuaagccugggacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaagaagcggaaucuaaccauaauggaucuccaucccgggucaggaaagacgcggaaauaccucccagcuauuguuagagaagcaaucaaaagacgcuuaaggacucuaauuuuggcaccaacaaggguggucgcagcugagauggaagaagcauugaaggggcucccaauaagguaucaaacaacugcaacaaaaucugcacacacagggaaagagauuguugaucuaaugugucacgcaacauuuacaaugcguuuacugucaccagucagaguuccaaacuauaacuugauaauaauggaugaggcucauuuuacagacccagcuagcauagcggcuagaggguacauaucaacucguguaggaaugggagaggcagccgcaauuuucaugacagccacgcccccuggcacagcugaugccuuuccucagagcaaugccccaauucaagaugaagaaagagacauaccagaacgcucauggaauucagguaaugaauggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagcgccgcgcaaaggagagggagaguuggcaggaacccacaaaaggaaaaugaccaauacauauucacgggccagccccucaauaaugaugaagaccacgcucacuggacagaagcaaaaaugcugcuagacaacaucaacacaccagaagggauuauaccagcucucuuugaaccagaaagggagaagucagccgccauagacggcgaauaccgccugaaaggugaauccaggaagaccuucguggaacucaugaggaggggugaccucccaguuuggcuagcccauaaaguagcaucagaaggaaucaaauauacagacagaaaauggugcuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcucuugaucuugugacagaaauaggaagagugccuucacaccuagcccacagaacgagaaacgcucuggacaaucuggugauguugcacacgucagaacauggugggagggcuuacaggcaugccguggaggaauuaccagaaacaauggaaacacucuuacuccugggacucaugauccuguuaacagguggggcaaugcuuuucuugauaucagguaaagggauuggaaagacuucaauaggacucauuugugugguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacauuggcugcaauaguggcagccaaugaaaugggauuguuggaaaccacaaagagagauuuaggaauguccaaagaaccagguguuguuucuccaacuagcuauuuggauguggauuugcacccagcaucagccuggacauuguacgcuguggccacaacaguaauaacaccaauguugagacacaccauagagaauuccacagcaaaugugucccuggcagcuauagccaaccaggcagugguccugauggguuuagacaaaggauggccgauaucgaaaauggacuuaggcguaccacuauuggcacuggguugcuauucgcaagugaacccacuaacucucacagcggcaguacuccugcuagucacgcauuacgccauuauagguccaggauugcaggcaaaagccacucgugaagcccaaaaaaggacagcugcuggaauaaugaagaauccaacgguggaugggauaaugacaauagaccuagauccuguaauauacgauucaaaauuugaaaagcaacuaggacagguuaugcuccugguucugugugcaguucaacuuuuguuaaugagaacauccugggcauuuugugaagcucuaacccuagccacaggaccaauaacaacacucugggaagggucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuugggagaaaaguggaaaaagaaauugaaucaauuaucucggaaagaauuugaccuuuacaagaaauccggaaucacugaaguggauagaacagaagccaaagaaggguugaaaagaggagaaauaacacaccaugccguauccagaggcagcgcgaaacuucaaugguucguggagagaaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaaguuaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacacuaggacaccuagacccaugccaggaacaagaaaggcuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucgcgugaaaacucuuucaguggaguagaaggggaaggacugcauaaacugggauacaucuugagagacauuuccaagauaccaggaggagcuauguaugcugaugacacagcugguugggacacaagaauaacagaagaugaccugcauaacgaggaaaaaaucacgcagcaaauggagccugaacacaggcaauuagcaaacgccauauuuaagcucacauaccaaaacaaaguggucaagguucaacgaccaacuccaaagggcacggugauggacaucauaucuaggaaagaccaaagaggcagcggacaggugggaacuuauggucugaauacauuuaccaacauggaaguucaguuaaucagacaaauggaaggagaaggugugcugucgaaggcagaccucgagaacccucaucugcuagagaaggaaauuacacaaugguuggaaacuaaaggaguggagagguuaaaaagaauggccaucagcggggaugauugcguggugaaaccaaucgaugacagguucgccgaugcccugcuugcccugaaugacauggggaaaguuaggaaggacauaccucaauggcagccaucgaagggauggcaugauuggcaacagguuccuuucugcucccaccacuuucaugaauugaucaugaaagauggaagaaaguugguaguccccugcagaccucaggaugaauuaauagggagagcgagaauuucucaaggagcaggauggagccuuaaagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaucaguggaugaccacagaggacaugcuuacuguuuggaacaggguguggauagaggacaauccauggauggaagauaaaacuccagucacaacuugggaagauguuccauaccuagggaagagagaagaccaauggugcggaucacucauuggucuugcuuccagagcaaccugggcccaaaacauacuuaccgcaauccaacagguaagaagccuuauaggcaaugaagaguuucuggacuacaugccuucgaugaagagauucaggaaggaggaggagucagagggagccauuugguaa

SEQ ID NO: 7717 - RNA, 9873 nt, Artificial Sequence
  derived and/or modified CDS sequence (wt) from DENV-3__KC762687__SS-prME
acaucgcucugucucaugaugauguuaccagcaacacuugcuuuccacuugacuucacgagauggagagccgcgcaugauuguggggaagaaugaaagagggaaaucccuucucuucaagacagccucuggaauuaauaugugcacacucauagccauggauuugggagagaugugugacgacacggucacuuacaaaugcccccuuaucacugaaguggagccugaagacauugacugcuggugcaaccucacaucgacgugggugaccuacggaacgugcaaccaagcuggagagcauagacgcgauaagagaucgguggcguuagcuccccaugucggcaugggacuggacacacgcgcccaaaccuggaugucggcugaaggagcuuggagacaaguugagaagguagagacaugggcuuuuaggcacccaggguucacaauacuagcccuauuucuugcccauuacauaggcacuuccuugacccagaaaguggucauuuucauacuacugaugcuggucaccccauccaugacaaugagaugugugggaguaggaaacagagauuucguggaaggccuaucaggagcuacguggguugacguggugcucgagcacggugggugugugacuaccauggcuaagaacaagcccacgcuagauauagagcuccagaagaccgaggccacccaacuggcgacccuaaggaaacuauguauugaggggaaaaucaccaacguaacaaccgacucaaggugccccacucaaggggaagcgauuuuaccugaggaacaggaccagaacuaugugugcaagcacacauacguggacagaggcuggggaaacgguugugguuuguuuggcaagggaagcuugguaacaugcgcgaaguuucaauguuuggaauuuauagagggaaaagugguacagcaugagaaccucaaauacaccgucaucaucacagugcacacaggagaccaacaucaggugggaaaugaaacgcagggagucacggcugagauaacaccucaggcaucaaccgucgaagccaucuuaccugaauaugguacccuugggcuagaaugcucaccacggacagguuuggauuucaaugaaaugauuuuguugacaaugaagaacaaagcauggaugguacauagacagugguuuuuugaccuaccucuaccauggacaucaggggccacaacagaaacaccaaccuggaacaagaaagaacuucuugugacauuuaaaaaugcacacgcaaaaaaacaagaaguaguaguccuuggaucgcaagagggagcaaugcacacagcacugacaggagcuacagagauccaaaccucaggaggcacaaguauuuuugcggggcacuuaaagugcagacucaagauggacaaauuggaacuuaaggggaugagcuaugcaaugugcuuaaaugccuuuguguugaagaaggaagucuccgaaacacaacaugggacaauacucauuaagguugaguacaaaggggaagaugcaccuugcaagauuccuuucuccacggaggauggacaagggaaagcccacaauggcagacugaucacagcuaacccagugguggucaagaaggaggagccugucaauauugaagcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguauuaaauucauuagggaaaauggugcaccaaauauuuggaagugcuuacacggccuuauuuaguggagucuccuggauaaugaaaauuggaauaggcguccuuuuaaccuggauaggguugaauucaaaaaacacuucuaugucauuuucaugcauugugauaggaaucaucacacucuaucugggagccguggugcaagcugacauggggugugucauaaacuggaaaggcaaagaacucaaauguggaagugggauuuucguuaccaaugagguccacaccuggacagagcaauacaaauuucaagcagacuccccuaagagacuggcaacagccauugcaggcgccugggaaaauggagugugcggaaucaggucgacaaccagaauggagaaccuuuuauggaagcaaauagccaaugaacugaacuacauauuaugggaaaacaacaucaaauugacggugguugugggugauauaauuggggucuuagagcaagggaaaagaacacugacaccacaacccauggagcuaaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuccgagagauguacacccaacuaugugaccacaggcuaaugucggcagccguuaaggaugagagagccguacacgccgacaugggcuauuggauagaaagccaaaagaauggaaguuggaaacuagaaaaggcaucccucauagaggugaaaaccugcacauggccaaaaucacacacucucuggagcaauggcgugcuagagagugacaugaucaucccaaagagucuggcugguccuguuucgcaacacaacuacaggcccggauaucacacccaaacggcaggaccuuggcaccuaggaaaauuggagcuggauuucaacuauugugaaggaacaacaguugucaucacagaaaauugugggacaagaggcccaucacugaggacaacaacagugucagggaaguugauacacgaaugguguugccgcucgugcacacuuccuccccugcgauacaugggagaagacggcuguugguauggcauggaaauuagacccauuaaugagaaagaagagaacaugguaaagucucuagucucagcagggaguggaaagguggauaacuucacaauggguguuuuauguuuggcaauccucuuugaagaggugaugagaggaaaauuuggaaaaaagcacaugaucgcagggguucucuuuacauuugugcuccuucucucagggcagauaacauggagagacauggcgcgcacacucauaaugauuggguccaacgccucugacagaaugggaaugggcgucacuuaccuagcauugauugcaacauuuaaaauucagccauuuuuggcuuugggauucuuccugaggaaacugacauccagagaaaauuuauuguugggaguugggcuggccauggcaacaacguuacaacugccagaggacauugaacaaauggcgaauggaauagcuuuggggcucauggcucucaaauugauaacacaauuugaaacauaccaacuauggacggcauuagucucccuaauguguucaaacacaauuuucacauugacuguugccuggagaacagccacccugauuuuggccggaaucucgcuuuuuccagugugccagucuucgagcaugaggaaaacagauuggcucccagugacuguggcagcuaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccacuaguggcugggggcuugcugauagcgugcuacgucauaacuggcacgucagcagaucucacuguagaaaaagcagcagaugugauaugggaggaagaggcugagcaaacaggagugucccauaauuuaaugaucacaguugaugaugauggaacaaugagaauaaaagaugaugagacugagaacauccuaacagugcuauugaaaacagcauuacuaauagugucaggcauuuuuccauacuccauacccgcaacacuguuggucuggcacacuuggcaaaagcaaacccaaagauccggcguccuaugggacguacccagccccccagagacacagaaagcagaacuggaagaaggggucuauaggauuaagcagcaaggaauuuuuggaaagacccaaguggggguuggaguacaaaaagaaggaguuuuccacaccauguggcacgucacaagaggagcagugcugacacacaaugggaaaagacuggaaccaaacugggcuagugugaaaaaagaucugauuucauacggaggaggauggagauugagugcacaauggcaaaaaggagaagaggugcagguuauugccguagagccugggaagaacccaaagaacuuccaaaccaugccaggcacuuuccagacaacaacaggggagauaggagcgauugcacuggacuucaagccugggacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauuguuagagaagcaaucaaaagacgcuuaaggacuuuaauuuuggcaccaacaagggugguugcagcugagauggaagaagcauugaaagggcuuccaauaagguaucaaacaacugcaacaaaaucuguacacacagggaaagagauuguugaucuaaugugucacgcaacauucacaaugcguuugcugucaccagucagaguuccaaacuauaacuugauaauaauggaugaggcucauuucacagacccagcuagcauagcggcuagaggguacauaucaacucguguaggaaugggagaggcagccgcaauuuucaugacagccacgcccccuggcacagcugaugccuuuccucagagcaaugccccaauccaagaugaagaaagagacauaccagaacgcucauggaauucagguaaugaauggauuaccgacuuugccgggaagacggugugguuugucccuagcaucaaagcuggaaaugacauagcaaacugcuugaggaaaaauggaaaaaaggucauucaacuuaguaggaagacuuuugacacagaauaucaaaagacuaaacuaaaugauugggacuuuguggugacaacagacauuucagaaaugggagccaauuucaaagcagacagagugaucgacccaagaaggugucucaagccagucauuuugacagacggacccgagcgcgugauccuggcgggaccaaugccagucaccguagcaagcgccgcgcaaaggagagggagaguuggcaggaacccgcaaaaggaaaaugaccaauacauauucacgggccagccccucaauaaugaugaagaccacgcucacuggacagaagcaaaaaugcugcuagacaacaucaacacaccagaagggauuauaccagcucucuuugaaccagaaagggagaagucagccgccauagacggcgaauaccgccugaaaggugaauccaggaagaccuucguggaacucaugaggaggggugaccucccaguuuggcuagcccauaaaguagcaucagaaggaaucaaauauacagacagaaaaugguguuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcucuugaucuugugacagaaauaggaagagugccuucacaccuagcccacaaaacgagaagcgcucuggacaaucuggugauguugcacacgucagaacauggugggagggcuuacaggcaugcaguggaggaauuaccagaaacaauggaaacacucuuacuccugggacucaugauccuguuaacagguggggcaaugcuuuuccugauaucagguaaagggauuggaaagaccucaauaggacucaucuguguaguugcuuccagcggcauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacacuggcugcaauaguggcagccaaugaaaugggauuguuggaaaccacaaagagagauuuaggaauguccaaagaaccagguguuguuucuccaaccagcuauuuggauguggauuugcacccagcaucagccuggacauuguacgcuguggccacaacaguaauaacaccaauguugagacacaccauagagaauuccacagcaaaugugucccuggcagcuauagccaaccaggcagugguccugauggguuuagacaaaggauggccgauaucgaaaauggacuuagguguaccacuauuggcacuggguugcuauucgcaagugaacccacuaacucuuacagcggcaguacuccugcuagucacgcauuaugccauuauagguccaggauugcaggcaaaagccacucgugaagcccaaaaaaggacagcugcuggaauaaugaagaauccaacgguggaugggauaaugacaauagaccuagauccaguaauauacgauucaaaauuugaaaagcaacuaggacagguuaugcuccugguucugugugcaguucaacuuuuguuaaugagaacaucaugggcauuuugugaagcucuaacccuagccacaggaccaauaacaacacucugggaagggucaccugggaaguucuggaacaccacgauagcuguuuccauggcgaacaucuuuagaggaagcuauuuagcaggagcugggcuugcuuuuucuaucaugaaaucaguuggaacaggaaagagaggaacagggucacaaggugaaaccuugggagaaaaguggaaaaagaaauugaaucaauuaucucggaaagaguuugaccuuuacaagaaauccggaaucacugaaguggauagaacagaagccaaagaaggguugaaaagaggagaaauaacacaccaugccguauccagaggcagcgcgaaacuucaaugguucguggagagaaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaacaaccaguuuugcauuaaaguauugaacccuuacaugccaacugugauugagcaccuagaaagacuacaaaggaaacauggaggaaugcuugugagaaauccacucucacgaaacuccacacacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaagucaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacaccaggacaccuagacccaugccaggaacaagaaaggcuauggagaucacagcggaauggcuuuggagaacccuaggaaggaacaaaagacccagauuaugcacgagagaagaguucacaaaaaaggucagaaccaacgcagcuaugggcgccguauucacagaggagaaccaaugggacagugcuaaagcugccguugaagaugaagaauucuggaaacucguggacagagaacgugaacuccacaaauugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucgcgugaaaacucuuucaguggaguagaaggggaaggacugcauaaacugggauacaucuugagagacauuuccaagauacccggaggagcuauguaugcugaugacacagcugguugggacacaagaauaacagaagaugaccugcacaaugaggaaaaaaucacgcagcaaauggacccugaacacaggcaauuagcaaacgccauauuuaagcuuacauaccaaaacaaaguggucaagguucaacgaccaacuccaaagggcacggugauggacaucauaucuaggaaagaccaaagaggcaguggacaggugggaacuuauggucugaauacauucaccaacauggaaguucaguuaaucagacaaauggaaggagaaggugugcugucgaaggcagaccucgagaacccucaucugcuagagaaggaaauuacacaaugguuggaaacuaaaggaguggagagguugaaaagaauggccaucagcggggaugauugcguggugaaaccaaucgaugacagguucgccgaugcccugcuugcccugaaugacauggggaaaguuaggaaggacauaccucaauggcagccaucgaagggauggcaugauuggcaacagguuccuuucugcucccaccacuuucaugaauugaucaugaaagauggaagaaaguugguaguccccugcagaccucaggaugaauuaauagggagagcgagaaucucucaaggagcuggauggagccuuagagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaccaguggaugaccacagaggacaugcuaacuguuuggaacaggguguggauagaggauaauccauggauggaagauaaaacuccagucacaacuugggaagauguuccauaucuagggaagagagaagaccaauggugcggaucacucauuggucuugcuuccagagcaaccugggcccaaaacauacuuaccgcaauccagcagguaagaagccuuauaggcaaugaagaguuucuggacuacaugccuucgaugaagagauucaggaaggaggaggagucagagggagccauuugguag

SEQ ID NO: 7718 - RNA, 9873 nt, Artificial Sequence
  derived and/or modified CDS sequence (wt) from DENV-3__KC762688__SS-prME
acaucgcucugccucaugaugauguuaccagcaacacuugcuuuccacuugaccucacgagauggagagccgcgcaugauuguggggaagaaugaaagagggaaaucccuucucuucaagacagccucuggaauuaauaugugcacacucauagccauggauuugggagagaugugugaugacacggucacuuacaaaugcccccuuaucacugaaguggagccugaggacauugacugcuggugcaaccucacaucgacgugggugaccuacggaacgugcaaccaagcuggagagcauagacgcgauaagagaucgguggcguuagcuccccaugucggcaugggacuggacacacgcgcccaaaccuggaugucggcugaaggagcuuggagacaaguugagaagguagagacaugggcuuuuaggcacccaggguucacaauacuagcccuauuucuugcccauuacauaggcacuuccuugacccagaaaguggucauuuucauacuacugaugcuggucaccccauccaugacaaugagaugugugggaguaggaaacagagauuucguggaaggccuaucaggagcuacguggguugacguggugcucgagcacggugggugugugacuaccauggcuaagaacaagcccacgcuagauauagagcuccagaagaccgaggccacccaacuggcgacccuaaggaaacuauguauugaggggaaaaucaccaacguaacaaccgacucaaggugccccacccaaggggaagcgauuuuaccugaggaacaggaccagaacuacguguguaagcacacauacguggacagaggcugggggaacgguugugguuuguuuggcaagggaagcuugguaacaugcgcgaaguuucaauguuuggaauuuauagagggaaaaguggugcagcaugagaaccucaaauacaccgucaucaucacagugcacacaggagaccaacaucaggugggaaaugaaacgcagggagucacggcugagauaacaccucaggcaucaaccgucgaagccaucuuaccugaauauggaacccuugggcuagaaugcucaccacggacagguuuggauuucaaugaaaugauuuuguugacaaugaagaacaaagcauggaugguacauagacagugguuuuuugaccuaccucuaccauggacaucaggggccacaacagaaacaccaaccuggaacaagaaagagcuucuugugacauuuaaaaaugcacacgcaaagaaacaagaaguaguaguccuuggaucgcaagagggagcaaugcacacagcacugacaggagccacagagauccaaaccucaggaggcacaaguauuuuugcggggcauuuaaagugcagacucaagauggacaaauuggaacucaaggggaugagcuaugcaaugugcuuaaaugccuuuguguugaagaaagaagucuccgaaacacaacaugggacaauacucauuaagguugaguacaaaggggaagaugcaccuugcaagauuccuuucuccacggaagauggacagggaaaagcccacaauggcagacugaucacagcuaauccaguggugaccaagaaggaggagccugucaauauugaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucuccuggauaaugaaaauuggaauaggcguccuuuuaaccuggauaggguugaauucaaaaaacacuucuaugucauuuucaugcauugugauaggaaucaucacacucuaucugggagccguggugcaagcugacaugggguguguuauaaacuggaaaggcaaagaacucaaauguggaagcgggauuuucguuaccaaugagguccacaccuggacagagcaauacaaauuucaagcagacuccccuaagagacuggcaacagccauugcaggcgccugggaaaauggagugugcggaaucaggucgacaaccagaauggagaaccuuuuguggaagcaaauagccaaugaacugaacuacauauuaugggaaaacaacaucaaauugacgguaguugugggugacauaauuggggucuuagagcaagggaaaagaacacugacaccacaacccauggagcuaaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuccgagagauguacacccaacuaugugaccacaggcuaaugucggcagccguuaaggaugagagagccguacacgccgacaugggcuauuggauagaaagccaaaagaauggaaguuggaaacuagaaaaggcaucccucauagaggugaaaaccugcacauggccaaaaucacacacucucuggagcaauggcgugcuggagagugacaugaucaucccaaagagucuggcugguccuguuucgcaacacaacuacaggcccggauaucacacccaaacggcaggaccuuggcaccuaggaaaauuggagcuggauuucaacuauugugaagggacaacaguugucaucacagaaaauugugggacaagaggcccaucacugaggacaacaacagugucagggaaguugauacacgaaugguguugccgcucauguacacuuccuccccugcgauacaugggagaagacggcuguugguauggcauggaaauuagacccauuaaugagaaagaagagaacaugguaaagucuuuagucucagcagggaguggaaagguggauaacuucacaauggguguuuuauguuuggcaauccucuuugaagaagugaugagaggaaaauucggaaaaaagcacaugauugcagggguucucuuuacuuuugugcuccuucucucagggcagauaacauggagagauauggcgcgcacacucauaaugauuggguccaacgccucugacagaaugggaaugggcgucacuuaccuagcauugauugcaacauuuaaaauucagccauuuuuggcuuugggauucuuccugaggaagcugacaucuagagaaaauuuauuguugggaguugggcuggccauggcaacaacguuacaacugccagaggacauugaacaaauggcgaauggaauagcuuuggggcucauggcucucaaauugauaacacaauuugaaacauaucaacuauggacggcauuaguuucccuaauguguucaaacacacuuuucacguugacuguugccuggagaacagccacccugauuuuggccggaauuucgcuuuugccagugugccagucuucgagcaugaggaaaacagauuggcucccaguuacuguggcagccaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccauuaguggcugggggcuugcugauagcgugcuacguuauaacuggcacgucagcagaccucacuguagaaaaagcagcagaugugauaugggaggaagaggcugagcaaacaggagugucccacaauuuaaugaucacaguugaugaugauggaacaaugagaauaaaagaugaugagacugagaacauccuaacagugcuacugaaaacagcauuacuaauagugucaggcauuuuuccauacuccauacccgcuacacuguuggucuggcacacuuggcaaaagcaaacccaaagauccggcguccuaugggacguacccagccccccagagacacagaaagcagaacuggaagaaggggucuauaggauuaagcagcaaggaauuuuugggaagacccaaguggggguuggaguacaaaaagaaggaguuuuccacaccauguggcacgucacaagaggagcagugcugacacacaacgggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuccaaaccaugccaggcauuuuccagacaacaacaggagagauaggagcgauugcacuggacuuuaagccugggacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaagaagcgaaaucuaaccauaauggaucuccaucccgggucaggaaagacgcggaaauaccucccagcuauuguuagagaagcaaucaaaagacgcuuaaggacucuaauuuuggcaccaacaaggguggucgcagcugagauggaagaagcauugaaagggcucccaauaagguaucaaacaacugcaacaaaaucugcacacacagggaaagagauuguugaucuaaugugucacgcaacauucacaaugcguuuacugucaccagucagaguuccaaacuauaacuugauaauaauggaugaggcucauuuuacagacccagcuagcauagcggcuagaggguacauaucaacucguguaggaaugggagaggcagccgcaauuuucaugacagccacgcccccuggcacagcugaugccuuuccucagagcaaugccccaauucaagaugaagaaagagacauaccagaacgcucauggaauucagguaaugaauggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaagaccaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagcgccgcgcaaaggagagggagaguuggcaggaacccacaaaaggaaaaugaccaauacauauucacgggccagccccucaauaaugaugaagaccacgcucacuggacagaagcaaaaaugcugcuagacaacaucaacacaccagaagggaucauaccagcucucuuugaaccagaaagggagaagucagccgccauagacggcgaauaccgccugaaaggugaauccaggaagaccuucguggaacucaugaggaggggugaccucccaguuuggcuagcccauaaaguagcaucagaaggaaucaaauauacagacagaaaauggugcuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcucuugaucuugugacagaaauaggaagagugccuucacaccuagcccacagaacgagaaacgcucuggacaaucuggugauguugcacacgucagaacauggugggagggcuuacaggcaugcaguggaggaauuuccagaaacaauggaaacacucuuacuccugggacucaugauccuguuaacagguggggcaaugcuuuucuugauaucagguaaaggaauuggaaagacuucaauaggacucauuuguguaguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacauuggcugcaauaguggcagccaaugaaaugggauuguuggaaaccacaaagagagauuuaggaauguccaaagaaccagguguuguuucuccaacuagcuauuuggauguggauuugcacccagcaucagccuggacauuguacgcuguggccacaacgguaauaacaccaauguugagacacaccauagagaauuccacagcaaaugugucccuggcagccauagccaaccaggcagugguccugauggguuuagacaaaggauggccgauaucgaaaauggacuuaggcguaccacuauuggcacugggcugcuauucgcaagugaacccacuaacucucacagcggcaguacuccugcuagucacgcauuacgccauuauagguccaggauugcaggcaaaagccacucgugaagcccaaaaaaggacagcugcuggaauaaugaagaauccaacgguagaugggauaaugacaauagaccuagauccuguaauauacgauucaaaauuugaaaagcaacuaggacagguuaugcuccugguucugugugcaguucaacuuuuguuaaugagaacauccugggcauuuugugaagcucuaacccuagccacaggaccaauaacaacacucugggaagggucaccugggaaguucuggaacaccacgauagcuguuuccauggcgaacaucuuuagagggagcuauuuagcaggagcugggcuugcuuuuucuaucaugaaaucaguuggaacaggaaagagaggaacggggucacaaggugaaaccuugggagaaaaguggaaaaagaaauugaaucaauuaucucggaaagaauuugaccuuuacaagaaauccggaaucacugaaguggauagaacagaagccaaagaaggguugaaaaaaggagaaauaacacaccaugccguauccagaggcagcgcgaaacuucaaugguucguggagagaaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaaguuaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacaccaggacaccuagacccaugccaggaacaagaaaggcuauggagaucacagcggaauggcuuuggagaacccugggaaggaacaaaagacccagauuaugcacgagagaggaguucacaaaaaaggucagaaccaacgcagcuaugggcgcaguauucacagaggagaaccaaugggacagugcuagagcugccguugaagaugaagaauucuggaaacucguggacagagaacgugaacuccacaaacugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucacgugaaaacucuuucaguggaguagaaggggaaggacugcauaaacugggauacaucuugagagacauuuccaagauacccggaggagcuauguaugcugaugacacagcugguugggacacaagaauaacagaagaugaccugcauaacgaggaaaaaaucacgcagcaaauggacccugaacacaggcaauuagcaaacgccauauuuaagcucacauaccaaaacaaaguggucaagguucaacgaccaacuccaaagggcacggugauggacaucauaucuaggaaagaccaaagaggcagcggacaggugggaacuuauggucugaauacauucaccaacauggaaguucaguuaaucagacaaauggaaggagaaggugugcugucgaaggcagaccucgagaacccucaucugcuagagaaggaaauuacacaaugguuggaaacuaaaggaguggagagguuaaaaagaauggccaucagcggggaugauugcguggugaaaccaaucgaugacagguucgccgaugcccugcuugcccugaaugacauggggaaaguuaggaaggacauaccucaauggcagccaucgaagggauggcaugauuggcaacagguuccuuucugcucccaccacuuucaugaauugaucaugaaagauggaagaaaguugguaguccccugcagaccucaggaugaauuaauagggagagcgagaauuucucaaggagcaggauggagccuuaaagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaucaguggaugaccacagaggacaugcuuacuguuuggaacaggguguggauagaggacaauccauggauagaagauaaaacuccagucacaacuugggaagauguuccauaucuagggaagagagaagaccaauggugcggaucacucauuggucuugcuuccagagcaaccugggcccaaaacauacuuaccgcaauccaacagguaagaagccuuauaggcaaugaagaguuucuggacuacaugccuucgaugaagagauucaggaaggaggaggagucagagggagccauuugguaa

SEQ ID NO: 7719 - RNA, 9873 nt, Artificial Sequence
  derived and/or modified CDS sequence (wt) from DENV-3__KC762689__SS-prME
acaucgcucugccucaugaugaugauaccagcaacacuugcuuuccacuugacuucacgagauggagagccgcgcaugauuguggggaagaaugaaagagggaaaucccuucuuuucaagacagccucuggaauuaauaugugcacacucauagccauggauuugggagagaugugugaugacacggucacuuacaaaugcccccuuaucacugaaguggagccugaagacauugacuguuggugcaaccucacaucgacgugggugaccuacggaacguguaaccaagcuggagagcauagacgcgauaagagaucgguggcguuagcuccccaugucggcaugggacuggacacacgcgcccaaaccuggaugucggcugaaggagcuuggagacaaguugagaagguagagacaugggcuuuuaggcacccaggguucacaauacuagcccuauuucuugcccauuacauaggcacuuccuugacccagaaaguggucaucuucauacuacugaugcuggucaccccauccaugacaaugagauguguggggguaggaaacagagauuucguggaaggccuaucaggagcuacguggguugacguggugcucgagcacggugggugugugacuaccauggcuaagaacaagcccacgcuagauauagagcuccagaagaccgaggccacccaacuggcgacccuaaggaaacuaugcauugaggggaaaaucaccaacguaacaaccgacucaaggugccccacccaaggggaagcgauuuuaccugaggaacaggaccagaacuacguguguaagcacacauacguggacagaggcuggggaaacgguugugguuuguuuggcaagggaagcuugguaacaugcgcgaaguuucaauguuuagaauuuauagagggaaaaguggugcagcaugagaaccucaaauacaccgucaucaucacagugcacacaggagaccaacaucaggugggaaaugaaacgcagggagucacggcugagauaacaccucaggcaucaacugucgaagccaucuuaccugaauauggaacccuugggcuagagugcuccccacggacagguuuggauuucaaugaaaugauuuuguugacaaugaagaacaaagcauggaugguacauagacagugguuuuuugaccuaccccuaccauggacaucaggggccacaacagaaacaccaaccuggaacaagaaagagcuucuugugacauuuaaaaaugcacacgcaaaaaaacaagaaguaguaguccuuggaucgcaagagggagcaaugcacacagcacugacaggagcuacagagauccaaaccucaggaggcacaaguauuuuugcggggcacuuaaagugcagacucaagauggacaaauuggaacucaaagggaugagcuaugcaaugugcuuaaaugccuuuguguugaagaaagaagucuccgaaacacaacaugggacaauacucauuaagguugaguacaaaggggaagaugcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucuccuggauaaugaaaauuggaauaggcguccuucuaaccuggauaggguugaauucaaaaaacacuucuaugucauuuucaugcauugugauaggaaucaucacacucuaucugggagccguggugcaagcugacauggggugugucauaaacuggaaaggcaaagaacucaaauguggaagugggauuuucguuaccaaugagguccacaccuggacagagcaauacaaauuucaagcagacuccccuaagagacuggcaacagccauugcaggcgccugggaaaauggagugugcggaaucaggucgacaaccagaauggagaaccuuuuguggaagcaaauagccaaugaacugaacuacauacuaugggaaaacaacauuaaauugacaguaguugugggugauauaauuggggucuuagagcaagggaaaagaacacugacaccacaacccauggagcuaaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuccgagagauguacacccaacuaugugaccacagguuaaugucggcagccguuaaggaugagagagccguacacgccgacaugggcuauuggauagaaagccaaaagaauggaaguuggaaacuagaaaaggcaucccucauagaggugaaaacaugcacauggccaaaaucacacacucucuggagcaauggcgugcuagagagugacaugaucaucccaaagagucuggcugguccugucucgcaacacaacuacaggcccggauaucacacccaaacggcaggaccuuggcaccuaggaaaauuggagcuggauuucaacuauugugaaggaacaacaguugucaucacagaaaguugugggacgagaggcccaucacugaggacaacaacagugucagggaaguugauacacgaaugguguugccgcucguguacacuuccuccccugcgauacaugggagaagacggcuguugguauggcauggaaauuagacccauuaaugagaaagaagagaacaugguaaagucuuuagucucagcagggaguggaaagguggacaacuucacaauggguguuuuauguuuggcaauccucuuugaagaggugaugagaggaaaauucgggaaaaagcacaugauugcagggguucucuuuacauuugugcuccuucucucagggcagauaacauggagagauauggcgcgcacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguugggcuggccauggcaacaacguuacaacugccagaggacauugaacaaauggcgaauggaauagcuuuggggcucauggcucucaaauugauaacgcaauuugaaacauaccaacuauggacggcauuagucucccuaauguguucaaacacaaucuucacguugacuguugccuggagaacagccacccugauuuuggccggaauuucgcuucugccagugugccagucuucgagcaugaggaaaacagauuggcucccagugacuguggcagcuaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccauuaguggcugggggcuugcugauagcgugcuacgucauaacuggcacgucagcagaccucacuguagaaaaagcagcagaugugauaugggaggaagaggcugagcaaacaggagugucccacaauuuaaugaucacaguugaugaugauggaacaaugagaauaaaagacgaugagacugagaacauccuaacaguacuauugaaaacagcauuacuaauagugucaggcauuuuuccauacuccauacccgcaacacuguuggucuggcacacuuggcaaaagcaaacccaaagauccggcguccuaugggacguacccagccccccagagacacagaaagcagaacuggaagaaggggucuauaggauuaagcagcaaggaauuuuugggaagacccaaguggggguuggagugcaaaaagaaggaguuuuccacaccauguggcacgucacaagaggagcagugcugacacauaaugggaagagacuggaaccaaacugggcuagcgugaagaaggaucugauuucauacggaggaggauggagacugagugcacaauggcaaaaaggagaagaggugcagguuguugccguagagccugggaagaacccaaaaaacuuccaaaccaugccaggcauuuuccagacaacaacgggggagauaggagcgauugcacuggacuucaagccugggacuucaggaucucccaucauaaacagagagggaaagguagugggacuguauggcaauggaguggucacaaagaaugguggcuaugucaguggaauagcucaaacaaacgcagaaccagacggaccgacaccagacuuggaagaagagauguucaaaaagcgaaaucuaaccauaauggaucuccaucccgggucaggaaagacgcggaaauaccucccagcuauuguuagagaagcaaucaaaagacgcuuaaggacucuaauuuuggcaccaacaaggguggucgcagcugagauggaagaagcauugaaagggcucccaauaagguaucaaacaacugcaacaaaaucuguacacacagggaaagagauuguugaucuaaugugucacgcaacauucacaaugcguuugcugucaccagucagaguuccaaacuauaacuugauaauaauggaugaggcucauuucacagacccagcuagcauagcagcuagaggguacauaucaacucguguaggaaugggagaggcagccgcaauuuucaugacagccacgcccccuggcacagcugaugccuuuccucagagcaaugccccaauucaagaugaagaaagagacauaccagaacgcucauggaauucagguaaugaauggauuaccgacuuugccgggaagacggugugguuugucccuagcaucaaagcugggaaugacauagcaaacugcuugcggaaaaauggaaaaaaggucauucaacuuaguaggaagacuuuugacacagaauaucaaaagacuaaacuaaaugauugggacuuuguggugacaacagacauuucagaaaugggagccaacuucaaagcagacagagugaucgacccaagaagaugucucaagccagucauuuugacagacggacccgagcgcgugauccuggcgggaccaaugccagucaccguagcgagcgccgcgcaaaggagagggagaguuggcaggaacccacaaaaggaaaaugaccaauacauauucacgggccagccccucaauaaugaugaagaccacgcccacuggacagaagcaaaaaugcugcuagacaacaucaacacaccagaagggauuauaccagcucucuuugaaccagaaagggagaagucagccgccauagacggcgaauaccgccugaaaggugaauccaggaagaccuucguggaacucaugaggaggggugaccucccaguuuggcuagcccauaaaguagcaucagaaggaaucaaauauacagacagaaaaugguguuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcccuugaucuugugacagaaauaggaagagugccuucacaccuagccuacagaacgagaaacgcucuggacaaucuagugauguugcacacgucagaacauggcgggagggcuuacaggcaugcaguggaggaauuaccagaaacaauggaaacacucuuacuccugggacucaugauccugcuaacagguggggcaaugcuuuucuugauaucagguaaagggauuggaaaaacuucaauaggacucauuuguguaguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacauuggcugcaauaguggcagccaaugaaaugggauuguuggaaaccacaaagagagauuuaggaauguccaaagaaccagguguuguuucuccaacuagcuauuuggauguggauuugcacccagcaucagccuggacauuguacgcuguggccacaacaguaauaacaccaauguugagacacaccauagagaauuccacagcaaaugugucccuggcagcuauagccaaccaggcagugguccugauggguuuagacaaaggauggccuauaucgaaaguggacuuaggcguaccacuauuggcacuggguugcuauucgcaagugaacccacuaacucucacagcggcaguacuccugcuagucacgcauuaugccauuauagguccaggauugcaggcaaaagccacucgugaagcccaaaaaaggacagcugcuggaauaaugaagaauccaacgguggaugggauaaugacaauagaccuagauccuguaauauacgauucaaaauuugaaaagcaacuaggacagguuaugcuccugguucugugugcaguucaacuuuuguugaugagaacaucaugggcauuuugugaagcucuaacccuagccacaggaccaauaacaacacucugggaagggucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuugggagaaaaguggaaaaagaaauugaaucaauuaucucggaaagaguuugaccuuuacaagaaauccggaaucacugaaguggauagaacagaagccaaagaaggguugaaaagaggagaaacaacacaccaugccguauccagaggcagcgcgaaacuucaaugguucguggagagaaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccgccugaaaagugugacacuuuauugugugacauuggagaaucuucaccaagcccaacaguggaagaaagcagaaccauaagagucuugaagaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaaguuaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacaccaggacaccuagacccaugccaggaacaagaaaggcuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucgcgugaaaacucuuucaguggaguagaaggggaaggacugcauaaacugggauacaucuugagagacauuuccaagauacccggaggagccauguaugcugaugacacagcugguugggacacaagaauaacagaagaugaccugcacaaugaggaaaaaaucacgcagcaaauggacccugaacacaggcaauuagcaaacgccauauuuaagcucacauaccaaaacaaaguggucaagguucaacgaccaacuccaaagggcacggugauggacaucauaucuaggaaagaccaaagaggcaguggacaggugggaacuuauggucugaauacauucaccaacauggaaguucaguuaaucagacaaauggaaggagaaggugugcugucgaaggcagaccucgagaacccucaucugcuagagaaggaaauuacacaaugguuggaaacuaaaggaguggagagguuaaaaagaauggccaucagcggggaugauugcguggugaaaccaaucgaugacagguucgccgaugcccugcuugcccugaaugacauggggaaaguuaggaaggacauaccacaauggcagccaucgaaaggauggcaugauuggcaacagguuccuuucugcucccaccacuuucaugaauugaucaugaaagauggaagaaaguugguaguccccugcagaccucaggaugaauuaauagggagagcgagaaucucucaaggagcaggauggagccuuaaagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaucaguggaugaccacagaggacaugcuuacuguuuggaacaggguguggauagaggacaauccauggauggaagauaaaacuccagucacaacuugggaagauguuccauaucuagggaagagagaagaccaauggugcggaucacucauuggucuugcuuccagagcaaccugggcccaaaacauacuuaccgcaauccaacagguaagaagccuuauaggcaaugaagaguuucuggacuacaugccuucgaugaagagauuuaggaaggaggaggagucagagggagccauuugguaa

SEQ ID NO: 7720 - RNA, 9873 nt, Artificial Sequence
  derived and/or modified CDS sequence (wt) from DENV-3__KC762690__SS-prME
acaucgcucugccucaugaugauguuaccagcaacacuugcuuuccaccugacuucacgagauggagagccgcgcaugauuguggggaagaaugaaagagggaaaucccuucucuucaagacagccucuggaauuaacaugugcacacucauagccauggauuugggagagaugugugaugacacggucacuuacaaaugcccccuuaucacugaaguggagccugaggacauugacugcuggugcaaccucacaucgacgugggugaccuacggaacgugcaaccaagcuggagagcauagacgcgauaagagaucgguggcguuagcuccccaugucggcaugggacuggacacacgcgcccaaaccuggaugucggcugaaggagcuuggagacaaguugagaagguagagacaugggcuuuuaggcacccaggguucacaauacuagcccuauuucuugcccauuacauaggcacuuccuugacccagaaaguggucauuuucauacuacugaugcuggucaccccauccaugacaaugagaugugugggaguaggaaacagagauuucguggaaggccuaucaggagcuacguggguugacguggugcucgagcacggugggugugugacuaccauggcuaagaacaagcccacgcuagauauagagcuccagaagaccgaggccacucaacuggcgacccuaaggaaacuauguauugaggggaaaaucaccaacguaacaaccgacucaaggugccccacccaaggggaagcgauuuuaccugaggaacaggaccagaacuacguguguaagcacacauacguggacagaggcugggggaacgguugugguuuguuuggcaagggaagcuugguaacaugcgcgaaguuucaauguuuggaauuuauagagggaaaaguggugcagcaugagaaccucaaauacaccgucaucaucacagugcacacaggagaccaacaucaggugggaaaugaaacgcagggagucacggcugagauaacaccucaggcaucaaccgucgaagccaucuuaccugaauauggaacccuugggcuagaaugcucaccacggacagguuuggauuucaaugaaaugauuuuguugacaaugaagaacaaagcauggaugguacauagacagugguuuuucgaccuaccucuaccauggacaucaggggccacaacagaaacaccaaccuggaacaagaaagagcuucuugugacauuuaaaaaugcacacgcaaagaaacaagaaguaguaguccuuggaucgcaagagggagcaaugcacacagcacugacaggagccacagagauccaaaccucaggaggcacaaguauuuuugcggggcauuuaaagugcagacucaagauggacaaauuggaacucaaggggaugagcuaugcaaugugcuuaaaugccuuuguguugaagaaagaagucuccgaaacacaacaugggacaauacucauuaagguugaguacaaaggggaagaugcaccuugcaagauuccuuucuccacggaggauggacagggaaaagcccacaauggcagacugaucacagcuaacccaguggugaccaagaaggaggagccugucaauauugaggcagaaccuccuuuuggggaaaguaacauaguaauuggaauuggagacaaagcuuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucucuuggauaaugaaaauuggaauaggcguccuuuuaaccuggauaggguugaauucaaaaaacacuucuaugucauuuucaugcauugugauagggaucaucacacucuaucugggagccguggugcaagcugacauggggugugucauaaacuggaaaggcaaagaacucaaauguggaagcgggauuuucguuaccaaugagguccacaccuggacagagcaauacaaauuucaagcagacuccccuaagagacuggcaacagccauugcaggcgccugggaaaauggagugugcggaaucaggucgacaaccagaauggagaaccuuuuguggaagcaaauagccaaugaacugaacuacauauuaugggaaaacaacaucaaauugacgguaguugugggugauauaauuggggucuuagagcaagggaaaagaacauugacaccacaacccauggagcugaaauauucguggaaaacauggggaaaggcgaaaauagugacagcugagacacaaaauuccuccuucauaauagaugggccaaacacaccagaguguccaagugccucaagagcauggaaugugugggagguggaagauuacggguucggagucuucacaacuaauauauggcugaaacuucgagagauguacacccaacuaugugaccacaggcuaaugucggcagccguuaaggaugagagagccguacacgccgacaugggcuauuggauagaaagccaaaagaauggaaguuggaaacuagaaaaggcaucccucauagaggugaaaaccugcacauggccaaaaucacacacucucuggagcaauggcgugcuggagagugacaugaucaucccaaagagucuggcugguccuguuucgcaacacaacuacaggcccggauaucacacccaaacggcaggaccuuggcaccuaggaaaauuggagcuggauuucaacuauugugaaggaacgacaguugucaucacagaaaauugugggacaagaggcccaucacugaggacaacaacagugucagggaaguugauacacgaaugguguugccgcucauguacacuuccuccccugcgauacaugggagaagacggcuguugguauggcauggaaauuagacccauuaaugagaaagaagagaacaugguaaagucuuuagucucagcagggaguggaaagguggauaacuucacaauggguguuuuaugucuggcaauccucuuugaagaggugaugagaggaaaauucggaaaaaagcacaugauugcagggguucucuuuacauuugugcuccuucucucagggcagauaacauggagagauauggcgcgcacacucauaaugauuggguccaacgccucugacagaaugggaaugggcgucacuuaccuagcauugauugcaacauuuaaaauucagccauuuuuggcuuugggauucuuccugaggaaacugacaucuagagaaaauuuauuguugggaguugggcuggccauggcaacaacguuacaacugccagaggauauugaacaaauggcgaauggaauagcuuuggggcucauggcucucaaauugauaacacaauuugaaacauaucaacuauggacggcauuaguuucccuaauguguucaaacacaauuuucacguugacuguugccuggagaacagccacccugauuuuggccggaauuucgcuuuugccagugugccagucuucgagcaugaggaaaacagauuggcucccaguuacuguggcagccaugggaguuccaccccuaccacuguuuaucuucaguuugaaagauacgcucaaaaggagaagcuggccacuaaaugagggggugauggccguuggacuugugagcauucuagcaaguucucuccuuaggaaugacguacccauggcuggaccauuaguggcugggggcuugcugauagcgugcuacguuauaacuggcacgucagcagaccucacuguagaaaaagcagcagaugugauaugggaggaagaggcugagcagacaggagugucccacaauuuaaugaucacaguugaugaugauggaacaaugagaauaaaagaugaugagacugagaacauccuaacagugcuauugaaaacagcauuacuaauagugucaggcauuuuuccauacuccauacccgcuacacuguuggucuggcacacuuggcaaaagcaaacccaaagauccggcguccuaugggacguucccagccccccagagacacagaaagcagaacuggaagaaggggucuauaggauuaagcagcaaggaauuuuugggaagacccaaguggggguuggaguacaaaaagaaggaguuuuccacaccauguggcacgucacaagaggagcagugcugacacacaacgggaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuccaaaccaugccaggcauuuuccagacaacaacaggagagauaggagcgauugcacuggacuuuaagccugggacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaagaagcggaaucuaaccauaauggaucuccaucccgggucaggaaagacgcggaaauaccucccagcuauuguuagagaagcaaucaaaagacgcuuaaggacucuaauuuuggcaccaacaaggguggucgcagcugagauggaagaagcauugaaggggcucccaauaagguaucaaacaacugcaacaaaaucugcacacacagggaaagagauuguugaucuaaugugucacgcaacauucacaaugcguuuacugucaccagucagaguuccaaacuauaacuugauaauaauggaugaggcucauuuuacagacccagcuagcauagcggcuagaggguacauaucaacucguguaggaaugggagaggcagccgcaauuuucaugacagccacgcccccuggcacagcugaugccuuuccucagagcaaugccccaauucaagaugaagaaagagacauaccagaacgcucauggaauucagguaaugaauggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagcgccgcgcaaaggagagggagaguuggcaggaacccacaaaaggaaaaugaccaauacauauucacgggccagccccucaauaaugaugaagaccacgcucacuggacagaagcaaaaaugcugcuagacaacaucaacacaccagaagggauuauaccagcucucuuugaaccagaaagggagaagucagccgccauagacggugaauaccgccugaaaggugaauccaggaagaccuucguggaacucaugaggaggggugaccucccaguuuggcuagcccauaaaguagcaucagaaggaaucaaauauacagacagaaaauggugcuuugauggagaacgcaacaaccaaauuuuagaagaaaauauggauguggaaaucuggacaaaggaaggagaaaagaaaaaauugaggccuagguggcuugaugcccgcaccuauucagaucccuuagcgcucaaggaauucaaggacuuugcggcugguagaaagucgaucgcucuugaucuugugacagaaauaggaagagugccuucacaccuagcccacagaacgagaaacgcucuggacaaucuggugauguugcacacgucagaacauggugggagggcuuacaggcaugccguggaggaauuaccagaaacaauggaaacacucuuacuccugggacucaugauccuguuaacagguggggcaaugcuuuucuugauaucagguaaagggauuggaaagacuucaauaggacucauuugugugguugcuuccagcgguauguuauggauggcugaugucccacuccaauggaucgcgucggccauaguccuggaguuuuuuaugauggugcuacuuauaccagaaccagaaaagcagagaacuccccaagacaaucaacucgcauauguugugauaggcauacucacauuggcugcaauaguggcagccaaugaaaugggauuguuggaaaccacaaagagagauuuaggaauguccaaagaaccagguguuguuucuccaacuagcuauuuggauguggauuugcacccagcaucagccuggacauuguacgcuguggccacaacaguaauaacaccaauguugagacacaccauagagaauuccacagcaaaugugucccuggcagcuauagccaaccaggcagugguccugauggguuuagacaaaggauggccgauaucgaaaauggacuuaggcguaccacuauuggcacuggguugcuauucgcaagugaacccacuaacucucacagcggcaguacuccugcuagucacgcauuacgccauuauagguccaggauugcaggcaaaagccacucgugaagcccaaaaaaggacagcugcuggaauaaugaagaauccaacgguggaugggauaaugacaauagaccuagauccuguaauauacgauucaaaauuugaaaagcaacuaggacagguuaugcuccugguucugugugcaguucaacuuuuguuaaugagaacauccugggcauuuugugaagcucuaacccuagccacaggaccaauaacaacacucugggaagggucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuugggagaaaaguggaaaaagaaauugaaucaauuaucucggaaagaauuugaccuuuacaagaaauccggaaucacugaaguggauagaacagaagccaaagaaggguugaaaagaggagaaauaacacaccaugccguauccagaggcagcgcgaaacuucaaugguucguggagagaaacauggucaucccugaaggaagagucauagacuugggcuguggaagaggaggcuggucauauuauugugcaggacugaaaaaaguuacagaagugcgaggauacacaaaaggcggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaagaaaauccuuauaaaacgugggcuuaccauggauccuaugaaguuaaggccacaggcucagccuccuccaugauaaauggaguugugaaacuccucacgaaaccaugggauguggugcccacggugacacagauggcaaugacggauacaaccccuuucggccagcaaaggguuuucaaagagaaaguggacacuaggacaccuagacccaugccaggaacaagaaaggcuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacugggcaaguguggaagcugcgucuacaacaugaugggcaagagagagaagaaacucggagaguuuggcaaagcaaaaggcaguagagccauaugguacaugugguugggagcuagguaccuugaguucgaggcgcucggauucuuaaaugaagaccauugguucucgcgugaaaacucuuucaguggaguagaaggggaaggacugcauaaacugggauacaucuugagagacauuuccaagauaccaggaggagcuauguaugcugaugacacagcugguugggacacaagaauaacagaagaugaccugcauaacgaggaaaaaaucacgcagcaaauggagccugaacacaggcaauuagcaaacgccauauuuaagcucacauaccaaaacaaaguggucaagguucaacgaccaacuccaaagggcacggugauggacaucauaucuaggaaagaccaaagaggcagcggacaggugggaacuuauggucugaauacauuuaccaacauggaaguucaguuaaucagacaaauggaaggagaaggugugcugucgaaggcagaccucgagaacccucaucugcuagagaaggaaauuacacaaugguuggaaacuaaaggaguggagagguuaaaaagaauggccaucagcggggaugauugcguggugaaaccaaucgaugacagguucgccgaugcccugcuugcccugaaugacauggggaaaguuaggaaggacauaccucaauggcagccaucgaagggauggcaugauuggcaacagguuccuuucugcucccaccacuuucaugaauugaucaugaaagauggaagaaaguugguaguccccugcagaccucaggaugaauuaauagggagagcgagaauuucucaaggagcaggauggagccuuaaagaaacugcaugccuggggaaagccuacgcccaaaugugggcucucauguauuuucacagaagagaucucagacuagcauccaacgccauauguucagcaguaccuguccacuggguccccacaagcaggacgacgugguccauucaugcucaccaucaguggaugaccacagaggacaugcuuacuguuuggaacaggguguggauagaggacaauccauggauggaagauaaaacuccagucacaacuugggaagauguuccauaccuagggaagagagaagaccaauggugcggaucacucauuggucuugcuuccagagcaaccugggcccaaaacauacuuaccgcaauccaacagguaagaagccuuauaggcaaugaagaguuucuggacuacaugccuucgaugaagagauucaggaaggaggaggagucagagggagccauuugguaa

SEQ ID NO: 7721 - RNA, 9873 nt, Artificial Sequence
  derived and/or modified CDS sequence (wt) from DENV-3__KC762691__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacaugggugaccuacggaacgugcaaccaagccggagagcauagacgcgauaagagaucgguggcguuagcuccucaugucggcaugggacuggacacacgcgcccaaaccuggaugucggcugaaggagcuuggagacaagucgagaagguagagacaugggcuuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuucguggaaggucuaucaggagcuacauggguugacguggugcucgaacacggugggugugugacuaccauggcuaagaacaagcccacgcuggacauagagcuccagaagaccgaggccacccaacuggcaacccuaaggaaacuaugcauugagggaaaaaucaccaacgugacaaccgacucaaggugccccacccaaggggaagcgauucuaccugaggagcaggaccagaacuacguguguaagcacacauacguggacagaggcuggggaaaugguugugguuuguuuggcaagggaagcuugguaacaugcgcgaaauuucaaugucuggaauuaauagagggaaaagugguucagcaugagaaccucaaauacaccguuaucaucacagugcauacaggagaccaacaccaggugggaaaugaaacgcagggagucacggcugaaauaacaccccaggcaucaaccgucgaagccaucuuaccugaauauggaacccuugggcuagaaugcucaccacggacagguuuggauuucaaugaaaugaucuuguugacaaugaaggacaaagcauggauggugcauagacaaugguuuuuugaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagcuacagagauccaaaccucaggaggcacaaguaucuuugcgggacacuugaaaugcagacucaagauggacaaauuggaacucaaggggaugagcuauacaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcucacaauggcagacugaucacggcuaacccaguggugaccaagaaggaagagccugucaauauugaggcagaacccccuuuuggggaaaguaacauaauaauuggaauuggagacaaagccuugaaaaucaauugguacaagaaggggagcucgauugggaagauguucgaggcaacugccaggggugcaaggcgcauggccaucuugggagacacagccugggacuuuggaucaguaggugguguuuuaaauucacuggggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaauuggaaaggcaaagaacucaaauguggaaguggaauuuucguuacuaaugagguccacaccuggacagagcaauacaaauuucaagcagacucccccagaagacuggcgacagccauugcaggagccugggagaauggagugugcggaaucaggucgacaaccagaauggagaaccucuuguggaagcaaauagcuaaugaacuaaacuacauauuaugggaaaacaacaucaaauuaacgguaguugugggugacacaauuggggucuuagagcaagggaaaagaacacuaacaccacaacccauggagcuaaaauauucauggaaaacauggggaaaagcgaaaauagugacagcugaaacacaaaauucauccuuuauaauagaugggccaaacacaccagaguguccaaaugccucaagagcauggaaugugugggagguggaagauuacggguucggagucuucacaacuaacauauggcugaaacuccgagagauguacacacaacuaugugaccacaggcuaaugucggcagccguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuggagagugacaugaucaucccaaagagucuggcugguccuaucucgcaacacaacuacaggccuggauaccacacccaaacggcaggacccuggcaccuaggaaaauuggagcuggacuucaacuauugugaaggaacaacaguugucaucacagaaaauuguggggcaagaggcccaucacugaggacaacaacagugucagggaaauugauacacgaaugguguugccgcucguguacacuuccuccccugcgauauaugggagaagauggcugcugguauggcauggaaauuagacccauuaaugagaaagaagagaacaugguaaagucuuuagucucagcagggaguggaaagguggauaacuucacaaugggugucuugugucuugcaauccucuucgaagagguaaugaggggaaaauucgggaaaaagcacaugauugcagggguucucuucacauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaagacauugaacaaauggcgaauggaauagccuuggggcucauggcucuuaaauugauaacacaauuugaaacauaccaacuauggacggcauuagucucccuaauguguucaaacacaauuuucacguugacuguugccuggagaacagccacccugauuuuggccggaauuucgcuuuuuccagugugccagucuucgagcaugaggaaaacagauuggcucccaaugacuguggcagcuaugggaguuccaccuuuaccacuuuuuauuuucaguuugaaagacacacuuaaaaggagaagcuggccacugaaugagggggugauggccguuggacuugugaguauccuagcaaguucucuccuuaggaaugacguacccauggcuggaccauuaguggcugggggcuugcugauagcguguuacgucauaacuggcacgucagcagaucucacuguagaaaaagcagcagaugugacaugggaggaagaagcugagcaaacgggagugucccacaaucuaaugaucacaguugaugaugauggaacaaugagaauaaaagaugaugagacugagaacaucuuaacagugcuuuugaaaacagcacuacuaauagugucaggcauuuuuccauacuccauaccugcaacacuucugguuuggcacacuuggcaaaagcaaacccaaagauccggcguccugugggacguacccagcccuccagagacacagaaagcagaacuggaagaaggggucuauaggaucaagcagcaaggaauuuuuggaaagacccaaguggggguuggaguacaaaaagaaggaguuuuccacacuauguggcacgucacaagaggagcaguguugacauacaauggaaaaagauuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuuuaaaccuggaacuucaggaucucccaucauaaacagagagggaaagguagugggacuauauggcaauggagugguaacaaagaaugguggcuaugucaguggaauagcucaaacaaacgcagaaccagacggaccgacaccagaguuggaagaagagauguucaaaaagcgcaaucuaaccauaauggaucuccaucccgggucaggaaagacgcggaaauaccucccagccauaguuagagaggcaaucaagagacgcuuaaggacucuaauuuuggcaccaacaagggugguugcagcugagauggaagaagcacugaaagggcucccaauaagguaucaaacaaccgcaacaaaaucugaacauacagggaaagagauuguugaucuaaugugccacgcaacguucacaaugcguuugcugucaccagucagaguuccaaacuacaacuugauaauaauggaugaggcucauuucacagacccagccaguauagcagcuaggggguacauaucaacucguguaggaaugggagaggcagccgcaauuuuuaugacggccacaccuccuggaacagcugaugccuuuccucagagcaacgcuccaauucaagaugaagaaagagacauaccagaacgcucauggaauucaggcaaugauuggauuacugacuuugcugggaagacugugugguuuguccccagcaucaaagcugggaaugacauagcaaacugcuugcggaaaaauggaaaaaaggucauucaacuuaguaggaaaacuuuugauacagaauaucaaaagacuaaacuaaaugauugggacuuuguggugacaacagacauuucagaaaugggagccaauuucaaagcagacagagugaucgacccaagaagaugccucaagccagucauuuugacggacggacccgagcgcgugauccuggcgggaccaaugccagucaccguagcgagugcugcgcaaaggagagggagaauuggcaggaacccacaaaaagaaaaugaccaauacauauucacgggccagccccucaacaaugaugaagaccacgcucacuggacagaagcgaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggaaaauauggauguggaaaucuggacaaaggaaggagaaaagaaaaaauugaggccuagguggcuugaugcccgcacuuauucagaucccuuagcgcucaaagaauucaaggacuuugcggcugguagaaagucgaucgcccuugaucuugugacagaaauaggaagagugccuucacaucuagcccacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauagucuuggaguucuuuaugauggugcuacuuauaccagaaccagaaaagcagagaacuccccaagacaaucaacucgcauaugucgugauaggcauacuuacauuggcugcaauaguagcggccaaugaaaugggauuguuggaaaccacaaagagagauuuggggauguccaaagaaccagguguuguuucgccaaccaguuauuuggauguggauuuacacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccaauaucgaaaauggacuuaggcgugccacuauuggcacuggguugcuauucacaagugaacccacuaacucucacagcggcaguacuccugcuagucacgcauuaugcuauuauagguccaggauugcaggcaaaagccacucgugaagcucaaaaaagaacggcugcuggaauaaugaagaauccaacgguggaugggauaaugacaauagaccuagauccuguaauauacgacucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuucuauggcaaacaucuuuagagggagcuaucuagcaggagcugggcuugcuuuuucuaucaugaaaucaguuggaacaggaaagagaggaacagggucacaaggugaaacuuugggagaaaaguggaaaaagaaacugaaucaauuaucccggaaagaguuugaccucuacaagaaauccggaaucacugaaguggauagaacagaagccaaagaaggguugaaaagaggagaaauaacacaccaugccguauccaggggcagcgcaaaacuucaaugguucguggagagaaacauggucauuccugaaggaagagucauagacuugggcuguggaagaggaggcuggucauauuacugugcaggauugaaaaaaguuacagaagugcgaggauacacaaaaggcgguccaggacaugaagaaccaguaccuaugucuacauauggauggaacauagucaagcugaugaguggaaaggauguguuuuaucuuccaccugaaaagugugacacucuauugugugacauuggagaauccucaccaagcccaacaguggaagagagcagaaccauaagagucuugaaaaugguugaaccauggcuaaaaaauaaccaguuuugcauuaaaguauugaauccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauaggagacccaccauagagaaagauguggauuuaggagcggggacccgacaugucaaugcggaaccagaaacacccaacauggaugucauuggggaaagaauaagaagaaucaaggaggagcauaguucaacauggcacuaugaugaugaaaauccuuacaaaacgugggcuuaccauggaucuuaugaaguuaaggccacaggcucagccuccuccaugauaaauggagucguaaaacuccucacgaaaccaugggauguggugcccacggugacacagauggcaaugacggacacaaccccuuuuggccagcaaaggguuuucaaagagaaaguggacaccaggacacccaaacccaugccaggaacaagaaagguuauggagauuacagcggaauggcuuuggagaacccugggaaggaacaaaagacccagauuaugcacgagagaggaguucacaaaaaaggucagaaccaacgcagcuaugggcgccguauucacggaggagaaccaaugggacagcgcuagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccacugguucucgcgugaaaacucuuacaguggaguagaaggggaaggacugcauaagcugggauauaucuugagagauauuuccaagauaccuggaggagccauguaugcugaugacacagcugggugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccagcugaucagacaaauggaaggagaagguguguugucgaagacagaccucgagaacccucaucuacuagagaagaaaauuacacaaugguuggaaaccaaaggaguggagagguuaaaaagaauggccaucagcggggaugauugcguggugaaaccaaucgacgacagguucgcuaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauugauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagacaugcuuacuguuuggaacaggguauggauagaggacaauccauggauggaagacaaaacuccagucacaacuugggaagauguuccauaucuggggaagagagaggaccaauggugcggaucacucauuggucucacuuccagagcaaccugggcccagaacauacuuaccgcaauccaacagguaagaagccuuauaggcaaugaagaguuucuggacuacaugccuucuaugaagagauucaggaaggaggaggagucagagggagccauuugguaa

SEQ ID NO: 7722 - RNA, 9873 nt, Artificial Sequence
  derived and/or modified CDS sequence (wt) from DENV-3__KC762692__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucauguuggcaugggacuggacacacgcgcccaaaccuggaugucagcugaaggagcuuggagacaagucgagaagguagagacaugggccuuuaggcacccaggguucacaauacuagcccuauuucucgcccauuacauaggcacuuccuugacccagaaaguggucauuuucauacuacuaaugcuggucaccccauccaugacaaugagaugugugggaguaggaaacagagacuuuguagaaggccuaucaggagcuacguggguugacguggugcucgaacacggugggugcgugacuaccauggcuaagaacaagcccacgcuggacauagagcuccagaagaccgaggcuacccaacuggcaacccuaaggaaacuaugcauugaggggaaaaucaccaacgugacaaccgacucaaggugccccacccaaggggaagcgauccuaccugaggagcaggaucagaacuacguguguaagcacacguacguggacagaggcuggggaaacgguugugguuuguuuggcaagggaagcuugguaacaugcgcgaaauuucaauguuuggaauuaauagagggaaaaguggugcagcaugagaaccucaaauacaccgucaucauuacagugcacacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguccauagacaaugguuuuucgaccuaccucuaccauggacaucaggggccacaacagaaacaccaaccuggaauaagaaagagcuucuugugacauucaaaaacgcacacgcaaaaaaacaagaagugguaguccuuggaucgcaagagggagcaaugcacacagcacugacaggagccacagagauccaaaccucaggaggcacaaguauuuuugcggggcacuugaaauguagacucaagauggacaaauuggaacucaaagggaugagcuaugcaaugugcucaaaugccuuuguguugaagaaagaagucucugaaacacaacaugggacaauacucauuaaggucgaauacaaaggggaagacgcaccuugcaagauuccuuucucuacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccauccugggagacacagccugggacuuuggaucaguaggugguguuuugaauucacuagggaaaauggugcaccaaauauuuggaagugcuuacacggcucuuuuuaguggaguuuccuggauaaugaaaauuggaauagguguccuuuuaacuuggauaggguugaauucaaaaaacacuucuaugucauuuucaugcauugugauaggaaucaucacacucuaucugggagccguggugcaagcugauauggggugugucauaaacuggaaaggcaaagaacucaaauguggaaguggaauuuucgucaccaaugagguccacaccuggacagagcaauacaaauuucaagcagacucccccaaaagacuggcgacagccauuguaggcgccugggagaauggaguguguggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaauacagaauuccuccuuuauaauagaugggccaaacacaccagaauguccaaaugccucaagagcauggaaugugugggagguggaagacuacggguucggagucuucacaacuaauauauggcugaaacuccgagagauguacacccaacuaugugaccacaggcuaaugucggcagcuguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuggagagugacaugaucaucccaaagagucuggcugguccuaucucgcaacacaacuacaggcccggauaccacacucaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguggauaacuucacaaugggugucuugugucuugcaauccucuuugaagagguaaugagaggaaaauuugggaaaaagcacaugauugcagggguucucuucauguuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaauugacauccagagaaaauuuauuauugggaguuggguuggccauggcaacaacguugcaacugccagaggacauugaacaaauggcgaauggaauagccuuagggcucaugguucuuaaauugauaacacaauuugaaacauaccaacuauggacggcauuagucucccuaacguguucaaauacaauuuucacguugacuguugccuggagaacagccacccugaucuuggccggaacuucgcuuuugccagugugccaguccucgagcaugaggaaaacagauuggcucccaaugacuguggcagcuaugggaguuccaccucuaccacuuuuuaucuuuaguuugaaagacacacuuaaaaggagaagcuggccacugaaugaaggggugauggccguuggacuugugagcauucuagcaaguucucuccuuaggaaugacguacccauggcuggaccauugguggcugggggcuugcuaauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacaguacuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaagggguuuuccacacuauguggcacgucacaagaggggcaguguugacauacaauggaaaaagacuggaaccaaacugggccagcgugaaaaaagaucugaucucauacggaggaggauggagacugagugcacaauggcaaaaaggagaagaggugcagguuauugccguagagccugggaagaacccaaagaacuuucaaaccaugccaggcauuuuccagacaauaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagauggaccgacaccagaguuggaagaagagauguucaaaaagcgaaaucuaacuauaauggaucuccaucccgggucaggaaagacgcggaaauaccuuccaacuauagucagagaggcaaucaagagacgcuuaaggacucuaauuuuggcaccaacuagggugguugcagcugagauggaagaagcauugaaaggacuuccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguauauaucaacucguguaggaaugggagaggcagccgcaauuuucaugacagccacacccccuggaacagcugaugccuuuccucagagcaacgcuccaauucaagaugaagagagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagauauuucagaaaugggagccaauuucaaagcagacagagugaucgacccaagaagaugucucaagccagucauuuuaacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcaaaaauguugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccuuccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuggcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguggucgcuuccagcggcauguuauggauggcugauaucccacuccaauggaucgcgucggccauaguucuggaguuuuuuaugauggugcuacucauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccaggcguugucucgccaaccagcuauuuggauguggauuugcacccagcaucagccuggacauuguacgcuguggccacaacagucauaacaccaauguugagacauaccauagagaauuccacagcaaaugugucccuggcagcuauagccaaccaggcagugguccugauggguuuagacaaaggauggccgauaucgaaaauggacuuaggcgugccucuguuggcacuggguugcuauucacaaguaaacccacuaacucucacagcggcaguacuccuguuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggaccaauaacaacacucugggaagguucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauuaaaucaauuaucccggaaagaguuugaccucuauaagaaauccggaaucacugaaguggauagaacagaagccaaagaaggguugaaaagaggagaaauaacacaccaugccguauccagaggcagcgcaaaacuucaaugguucguggagagaaacauggucauucccgaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuacugugugacauuggagaaucuucaccaaguccaacaguggaagagagcagaaccauaagagucuugaaaaugguugaaccauggcuaaaaaauaaccaguuuugcauuaaaguauugaacccuuauaugccaacugugauugagcaccuagaaagauuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauagaagacccaccauagagaaagauguggauuugggagcgggaacccgacaugucaaugcggaaccagaaacacccaacauggaugucauuggggaaagaauaagaaggaucaaggaggagcauagcucaacauggcacuaugaugaugaaaauccuuacaaaacgugggcuuaccauggaucuuaugaagucaaggccacaggcucagccuccuccaugauaaauggagucgugaagcuccucacgaaaccaugggauguggugcccacggugacacagauggcaaugacggacacaacuccuuuuggccagcaaaggguuuuuaaagagaaaguggacaccaggacacccaaacccaugccaggaacaagaaagauuauggagaucacagcgggauggcuuuggagaacccugggaaggaauaaaagacccagauugugcacgagagaggaguucacaaaaaaggucagaaccaacgcagcuaugggcgccguauucacagaggagaaccaaugggacagugcuagagcugccguugaagaugaagaguucuggaaacucguggacagagaacgugaacuccacaaacaaggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcauaaugaggaaaaaaucacacagcaaauggacccugaacacaggcaguuagcaaaugcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagaaaagaaaauuacacaaugguuggaaaccaaaggaguggagagguuaaagagaauggccaucagcggggaugauuguguggugaaaccaaucgacgacagguucgccaaugccuugcuugcccugaaugacaugggaaaaguuaggaaggacauaccccaauggcagccaucgaagggauggcaugauuggcaacaggucccuuucugcucccaccacuuucaugaauugauuaugaaagauggaagaaauuugguagucccuugcagaccucaggaugaauuaauagggagagcuagaaucucucagggagcaggauggagccuuaaagaaacugcaugccuagggaaagccuacgcccaaaugugggcucucauguauuuucacagaagagaucuuagacuagcauccaacgccauauguucagcagugccaguccauuggguccccacaagcagaacgacguggucuauccaugcucaccaucaguggaugacuacagaaaacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcucagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7723 - RNA, 9873 nt, Artificial Sequence
  derived and/or modified CDS sequence (wt) from DENV-3__JQ920481__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgguaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagauacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcugcuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagauauuuccaagauacccggaggagcuauguaugcugaugacacagcugguugggacacaagaauaacagaagaugaccugcacaaugaggaaaaaaucacacagcaaauggauccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcccaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7724 - RNA, 9873 nt, Artificial Sequence
  derived and/or modified CDS sequence (wt) from DENV-3__JQ920483__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcagaaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugagacgcaacaugggacgauacucauuaagguugaguacaaaggggaagaugcaccuugcaagauuccuuucuccacggaggacggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacauuaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcacugauugcaacauuuaaaauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacucuauacccgcaacacuauugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaauccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgugugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauucuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuucuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaucaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaggaaaguuacacaaugguuggaaacaaaaggaguggagagguuaaaaagaauggccaucagcggggaugauugcguggugaagccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaauggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7725 - RNA, 9873 nt, Artificial Sequence
  derived and/or modified CDS sequence (wt) from DENV-3__JQ920482__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcaacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugagacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacauuaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaagauucagccauuuuuggcguuaggauucuuccugaggaaacugacauccagagaaaaucuauugcugggaguuggguuggccauggcaacaacguuacaacugccagaggacauugaacaaauggcgaauggaauagcuuuggggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuauugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgugugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggaaaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcccacagaacgagaaacgcccuggacaaucuggugauguugcacacgucagaacauggcgggagggccuacaggcaugcaguggaggaacuaccagaaacaauggaaacacuucuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaauggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7726 - RNA, 9873 nt, Artificial Sequence
  derived and/or modified CDS sequence (wt) from DENV-3__JQ920484__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaaugcagacucaagauggacaaauuggaacucaaggggaugagcuaugcaaugugcuugaaugccuucguguugaagaaagaagucucugagacgcaacaugggacgauacucauuaagguugaguacaaaggggaagaugcaccuugcaagauuccuuucuccacggaggauggacaagggaaagcccacaacggcagacugaucacagcuaacccaauagugacuaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuagcggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuuugucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacauuaaauuaacgauaguugugggugaugcaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagaggugaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaagauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuauugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacauacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgugugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagacccagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaauggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7727 - RNA, 9873 nt, Artificial Sequence
  derived and/or modified CDS sequence (wt) from DENV-3__JQ920486__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcucauuacauaggcacuucccugacccagaaagugguuauuuucauacuacuaaugcuggucaccccauccaugacaaugagaugugugggagugggaaacagagauuuuguggaaggccuaucaggagcuacuuggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaaugucuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuuguaacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugagacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggagaacaacauuaaauuaacgauaguugugggugaugcaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgucgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaagauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuauugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaaccgcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgugugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacucacguuggcugcaauaguagcagccaaugaaaugggacuguuggaaaccacaaagagagauuugggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaauagaagccaaagaaggguugaaaagaggagaaauaacacaccaugccguguccagagguagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcugcugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuucaaagagaaaguggacaccaggacacccagacccaugccaggaacaagaaagguuauggagaucacagcggaauggcuuuggagaacccugggaaggaacaaaagacccagacuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaauggaugaccacagaagauaugcuuacuguuuggaacaggguguggauagaggacaauccauggauggaggacaaaacuccagucacaaccugggaagauguuccauaucuaggaaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7728 - RNA, 9873 nt, Artificial Sequence
  derived and/or modified CDS sequence (wt) from DENV-3__JQ920485__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaacauaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugaguuaugcaaugugcuugaaugccuucguguugaagaaagaagucucugagacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucuccuaaaagacuggcgacagccauugcaggcgcuugggagaauggagugugcggaaucaggucgacaaccagaauggagaaccuccuguggaagcaaauagcuaaugaacugaacuacauauuaugggaaaacaacauuaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagaagcacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaagauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugagaaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcuugcuacgucauaacuggcacgucagcagaccucacuguagaaaaagcagcagaugugacaugggaggaagaggcugaacaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuauugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgauaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcggcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacucaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgugugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauagguauacucacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcaguggccacaacgguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaauagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaaguacgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacaugaaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagggaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucaggcaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaauggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagccagagggagccauuugguaa

SEQ ID NO: 7729 - RNA, 9873 nt, Artificial Sequence
  derived and/or modified CDS sequence (wt) from DENV-3__FJ644564__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgagguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagccaucuugccugaauauggaacccuugggcuagaaugcucaccacggacagguuuggacuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucaucacacucuaucugggagcuguggugcaagcugacauggggugugucauaaacuggaaaggcaaagaacuuaaaugcggaaguggaauuuucgucaccaacgagguccauaccuggacagagcaguacaaauuccaagcagacuccccaaaaagauuggcgacagccauugcaggcgcuugggagaauggagugugcggaauuaggucaacaaccagaauggagaaucucuuguggaagcaaauagccaaugaacugaacuacauauuaugggaaaacaauaucaaauuaacgguaguugugggcgacacaauugggguuuuagagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcuggucccauuucgcaacacaaccacaggcccggguaccacacccaaacggcaggacccuggcacuuagaaaauuuggagcuggacuucaccuauugugaaggaacaacaguugucaucacagaaaacugugggacaagaggcccaucauugagaacgacaacaguaucaggaaaguugauacacgaaugguguugccgcucgugcacacuuccuccucugcgauacaugggagaagacggcuguugguauggcauggaaaucagacccaucagugagaaagaagagaacaugguaaagucuuuagucucagcgggaaguggaaagguagacaacuucacaauggguaucuugugcuuggcaauccucuuugaagaggugaugagaggaaaauuugggaagaaacacaugauugcagggguuuucuucacguuugugcuccuucucucagggcaaauaacauggagagacauggcgcacacacuaauaaugauuggguccaacgccucugacaggaugggaaugggcgucaccuaucuagcuuugauugcaacauuuaaaauccagccauuccuggcuuugggauuuuuccuaagaaaacugacaucuagagaaaauuuacuguuaggaguuggacuggcuauggcaacaacguuacaacugccagaggacauugaacaaauggcaaauggaaucgcccuggggcucauggcucuuaaauugauaacacaauuugaaacauaccaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuugccaguucucuccuuagaaaugacguacccauggcuggaccauuaguggccgggggcuugcugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucuaacagugcuuuugaagacagcauuacuaauaguaucagguauuuuuccauacuccauacccgcaacauuguuggucuggcauacuuggcaaaagcaaacccaaagauccgguguucuaugggacguacccagccccccagagacacagaaagcagaacuggaagaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagcccgggaagaacccaaagaacuuucaaaccaugccaggcacauuucagacuacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaauuauaacuugauaauaauggaugaggcccauuucacagacccagccaguauagcggccagaggguacauaucaacucguguuggaaugggagaggcagccgcaauuuucaugagugcaacgcccccuggaacagcugaugccuuuccucagagcaaugcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugaucuuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcccacaaaguagcaucagaagggaucaaauauacagauaggaaauggugcuuugauggacagcgcaacaaucaaauuuuagaggaaaacauggacguggaaaucuggacaaaggaaggagaaaagaaaaaauugagaccuagguggcuugaugcccgcacuuauucagaucccuuagcacucaaggaauucaaggacuuugcggcuggcagaaagucaauugcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacuguuggaaacuacaaagagagauuuaggaaugucuaaggagcccgguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaauuacacauuaugcuauuauagguccaggacugcaggcaaaagccacucgugaagcucaaaaaaggacagcugcuggaauaaugaagaauccaacgguggaugggauaauaacgauagaccuagauccuguaauauacgauucaaaauuugaaaagcaacugggacaggucaugcuccugguuuugugugcaguucaacuguuguuaaugagaacaucaugggccuugugugaagcuuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaauuaucccggaaagaguuugaccuuuacaagaagucuggaaucacugaaguggauagaacagaagccaaagaaggguugaaaagaggagaaacaacacaucaugccgugucuagagguagugcaaaacuucaaugguuaguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuguuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccacggaucuuaugaagucaaagccacaggcucagccuccuccaugauaaauggagucgugaaacuucucacuaaaccaugggauguggugcccauggugacacagauggcaaugacagauacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggcgccguuuucacagaggagaaccaaugggacagugcgaaagcugcuguugaggaugaagaguuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggauccagguaccuugaguucgaagcccuuggauucuuaaaugaagaccacugguucucgcgugaaaacucuuacaguggaguagaaggagaaggacugcacaagcuaggcuacauauuaagggauaucuccaagauacccggaggagccauguaugcugaugacacagcugguugggacacaagaauaacagaagaugaccugcacaaugaggaaaagaucacacagcaaauggacccugaacacaggcuguuagcgaacgcuauauucaagcucacauaccaaaacaaaguggucaaaguucaacgaccgacuccaacgggcacgguaauggacaucauaucuaggaaagaccaaaggggcaguggacaggugggaacuuauggucugaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaauugaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuaucggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7730 - RNA, 9873 nt, Artificial Sequence
  derived and/or modified CDS sequence (wt) from DENV-3__HQ235027__SS-prME
acaucgcucugucucaugaugauauugccagcagcacuugcuuuccacuugacuucacgagauggagagccgcgcaugauuguggggaagaaugaaagaggaaaaucccuacuuuuuaaaacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcauagacgcgacaagagaucaguggcguuagcuccccaugucggcaugggacuagacacacgcacccaaaccuggaugucggcugaaggagcuuggaggcaagucgagaagguagagacaugggcccuuaggcauccaggguucaccauacuagcccuauuucuugcccauuacauaggcacaucuuugacccagaaggugguuauuuuuauacuacuaaugcuggucaccccauccaugacaaugagaugugugggaguaggaaacagggauuuuguggaaggucuaucaggagcuacguggguugacguggugcucgagcacggggggugugugacuaccauggccaagaacaagccaacguuggauauagagcuccagaagaccgaggcuacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaauaugagaaccucaaauacaccgucaucaucacagugcacacaggagaucaacaccaggugggaaacgaaacgcagggagucacggcugagauaacaccucaggcaucaaccacugaagccaucuugccugaauauggaacccuuggguuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaaguaguuguccuuggaucgcaagagggagcaaugcauaccgcauugacaggagccauagaaauccaaaacucaggaggcacaaguauuuuugcggggcacuuaaaauguagacuuaagauggacaaauuggaacucaaggggaugagcuacgcaaugugcacgaaaaccuuuguguugaagaaagaagucucagaaacgcagcaugggacaauacucauuaaggucgaguacaaaggggaagaugcaccuugcaagauuccuuucuccacagaggauggacaagggaaagccuacaauggcagacugauuacagccaacccaguggugacuaagaaggacgagccugucaauauugaggcugaaccuccuuuuggggaaaguaauauagugauuggaauuggagacaaugccuugaaaaucaacugguauaagaaaggaagcucuauugggaagauguuugaggccacugccagaggugcaaggcgcauggccaucuugggagacacagccugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacauauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauacaauuggggucuuagagcaaggaaaaagaacacuaacaccacaacccauggagcuaaaauacucauggaaaacguggggaaaggcaaaaauagugacagcugaaacacaaaauuccucuuucauaauagacgggccaaacacaccagaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugacaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacgacaacagugucagggaaguuaauacacgaaugguguugccguucgugcacacuuccucccuugcgauacaugggagaagacgguugcugguauggcauggaaaucagacccaucagugagaaagaagagaacaugguaaagucuuuggucucagcaggaaguggaaagguggacaacuucacaaugggugucuuguguuuggcaauccucuuugaagaggugaugagaggaaaauuugggaagaaacacaugauugcggggguuuucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuccaccucuaccacuuuuuauuuuuagcuugaaagacacacuuaaaaggagaagcuggccacugaaugaaggggugauggcuguugggcuugugagcauucuggccaguucucuccuuagaaaugauguacccauggcuggaccauuaguggccgggggcuugcugauagcgugcuacgucauaacuggcacgucagcagaccucaccguagaaaaagcagcagauauaacaugggaggaagaggcugaacaaacaggagugucccacaacuuaaugaucacaguugaugaugauggaacaaugagaauaaaagaugaugagacugagaauauccuaacaguacuuuugaaaacagcauuacuaguagugucaggagucuuuccauacuccauacccgcaacauugcuggucuggcauacuuggcaaaagcaaacccaaagauccggcguucuaugggacgugcccagccccccagagacacagaaagcagaacuggaagaaggggucuauaggaucaagcagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagauuugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacguuagcggaauagcgcaaacgaaugcagaaccagauggaccgacaccagaauuggaagaggagauguucaaaaagcgaaaucuaaccauaauggaucuucauccugggucaggaaagacacggaaauaccuuccagcuauuguuagagaggcaaucaagagacguuugagaacucuaauuuuggcaccgacaagggugguugcagcugagauggaagaagcauugaaaggccucccaauaagguaccaaacaacagcaacaaaaucugaacacacaggaagagagauuguugaucuaaugugccacgcaacguucacaaugcguuugcugucaccaguuaggguuccaaacuauaacuugauaauaauggaugaagcccauuucacagacccagccaguauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccaguaauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacauuaauacaccagaagggaucauaccagcucucuuugagccagaaagggagaagucagccgccauagacggugaguaccgcuugaaaggugagucuaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaauugagaccuagguggcuugaugcucgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacaucagaacauggcgguagggccuacaggcaugcgguggaggaacuaccagagacaauggaaacacuccuacucuugggacucaugaucuuguugacagguggggcaaugcuuuucuuaauaucagguaaagggauuggaaagaccucaauaggacucauuugugugauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacucacauuggcugcaauaauagcagccaaugaaaugggauugcuggaaacuacaaagagagauuuaggaaugucuaaggagccagguguugucucuccaaccagcuauuuagacguggacuugcacccagcaucagccuggacauuguacgccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuauuauagguccaggauugcaggcaaaagccacucgcgaagcucagaaaaggacagcugcuggaauuaugaagaauccaacgguggaugggauaaugacaauagaccuagauccuguaauauaugauucaaaauuugaaaagcaacugggacagguuaugcuccugguuuugugugcaguucaacuuuuguugaugagaacaucaugggccuugugugaagcuuuaacucuagcuacaggaccaauaacaacacucugggaaggaucaccugggaaguuuuggaacaccacgauagcuguuuccauggcgaacaucuuuagagggagcuauuuggcaggagcugggcuugcuuuuucuauuaugaaaucaguuggaacaggaaaaagaggaacaggcucacaaggugaaacuuuaggagaaaaauggaaaaagaaacuaaaucaacuaucccggaaagaguuugaccguuacaagaaaucuggaaucacugaaguggauagaacagaagccaaagaaggguugaaaagaggagaaacaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaauauugaacccuuacaugccaacugugauugagcaccuagagagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacauagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucaccaaaccaugggauguggugcccauggugacacagauggcaaugacagauacaacuccauuuggccagcagagagucuuuaaagagaaaguggacaccaggacacccagguccaugccaggaacaagaagggucauggggaucacagcagaguggcucuggagaacccugggaaggaacaaaaaacccagguuaugcacaagggaagaguuuacaaaaaaggucagaacuaacgcagccaugggcgccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaaaaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggagaccaaaggaguggagaggcuaaaaagaauggccauuagcggggaugauugcguagugaaaccaaucgaugacagauucgcuaaugcccugcuugcucugaacgauaugggaaagguucggaaagacauaccccaauggcagccaucaaagggauggcaugacuggcaacagguuccuuucugcucccaccacuuucaugaauugaucaugaaagauggaagaaaguuggugguucccugcagaccccaggacgaacuaauaggaagagcaagaaucucccaaggagcgggauggagccucagagaaaccgcaugucuggggaaagccuacgcucaaauguggagucucauguauuuucacagaagagaccucagacuagcaucuaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaagauguuccauaucuagggaagagagaagaccaaugguguggaucacuuauuggucucacuuccagagcaaccugggcccagaacauacccacagcaauccaacaggugagaagccuuauaggcaaugaagaguuucuggacuacaugccuucaaugaagagauuuaggaaggaggaggagucggagggagccauuugguaa

SEQ ID NO: 7731 - RNA, 9873 nt, Artificial Sequence
  derived and/or modified CDS sequence (wt) from DENV-3__JQ920476__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaaugcucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguucuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuuaaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaaaugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaaugugcucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugaucuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagugguauguuauggauggcugauguuccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaucagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacuuugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauagcucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucucacaguggaguagaaggagaaggacugcauaaacugggauacaucuuaagagacauuuccaagauacccggaggagcuauguaugcugaugacacagcugguugggacacaagaauaacagaagaugaccugcacaaugaggaaaaaaucacacagcaaauggacccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7732 - RNA, 9873 nt, Artificial Sequence
  derived and/or modified CDS sequence (wt) from DENV-3__JQ920477__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcuaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccuuaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaggaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuccaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugaucuugacagacggacccgagcgcgugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccuaggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcaucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguagccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccugugauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguugaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7733 - RNA, 9873 nt, Artificial Sequence
  derived and/or modified CDS sequence (wt) from DENV-3__JQ920478__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucaucacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaagaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccauaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccuuaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaccuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgcgugauccuggcgggaccaaugccagucaccguagcgagcgcugcacaaaggagagggagagucggcaggaacucacaaaaagagaaugaccaauacauauucacgggccagccccuuaauaaugaugaagaccaugcucacuggacagaagcaaaaaugcuguuagacaacauuaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuggcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccaggggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggaucuggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcgucuacaacaugaugggcaagagagagaagaaacucggagaguuuggcaaagcaaaaggcaguagagccauaugguacaugugguugggagccagguaccuugaguucgaagcacucggauucuuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugauaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugaccacagaagauaugcuuacuguuuggaacaggguguggauagaggacaauccauggauggaggacaaaacuccagucacaaccugggaagacguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7734 - RNA, 9873 nt, Artificial Sequence
  derived and/or modified CDS sequence (wt) from DENV-3__JQ920480__SS-prME
acaucgcucugucucaugaugauguuaccagcaacacuugcuuuccauuuaacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucaucacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuaugcauugaaggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugauuauggaacccuugggcuagaauguucaccacggacaggucuagauuucaaugaaaugauuuuguugacaaugaagaacaaagcauggaugguacauagacaaugguuucuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuuugucacuaaugagguucacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccuuaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaaugaaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaucacacccaaacggcaggacccuggcacuuaggaaaauuggagcuggacuucaacuauugcgaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucauguuugugcuccuucucucagggcaaauaacauggagagacauggugcacacacucauaaugauuggguccaacgccucugacagaaugggaaugggcgucacuuaccuagcauugauugcaacauuuaaaauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggcuguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucguacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucuccuaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagaccaaacugaaugauugggacuuuguggugacaacagacauuucagaaaugggagccaauuucaaagcagacagagugauugacccaagaagaugucucaagccagugaucuugacagacggacccgagcgcgugauccuggcgggaccaaugccagucaccguagcaagcgcugcacaaaggagagggagagucggcaggaacucacaaaaagagaaugaccaauacauauucacgggccagccccuuaauaaugaugaagaccaugcucacuggacagaagcaaaaaugcuguuagacaacauuaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcccacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagcuacucgugaagcucaaaaaaggacagcugcaggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacaauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagcuauaugguacaugugguugggagccagguaccuugaguucgaagcacucggauucuuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7735 - RNA, 9873 nt, Artificial Sequence
  derived and/or modified CDS sequence (wt) from DENV-3__JQ920479__SS-prME
acaucgcucugucucaugaugauguuaccagcaacacuugcuuuccauuuaacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucaucacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuaugcauugaaggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuucuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguucacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccuuaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaaugaaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaucacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucauguuugugcuccuucucucagggcaaauaacauggagagacauggugcacacacucauaaugauuggguccaacgccucugacagaaugggaaugggcgucacuuaccuagcauugauugcaacauuuaaaauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggcuguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucguacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucuccuaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgcgugauccuggcgggaccaaugccagucaccguagcgagcgcugcacaaaggagagggagagucggcaggaacucacaaaaagagaaugaccaauacauauucacgggccagccccuuaauaaugaugaagaccaugcucacuggacagaagcaaaaaugcuguuagacaacauuaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcccacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagcuacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuacagugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagcuauaugguacaugugguugggagccagguaccuugaguucgaagcacucggauucuuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7736 - RNA, 9873 nt, Artificial Sequence
  derived and/or modified CDS sequence (wt) from DENV-3__KU216208__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaaguugagaagguagagacaugggcccuuaggcacccaggguucaccauacuagcccuauuucuugcccauuacauaggcaccuccuugacccagaaggugguuauuuuuauacuacuaaugcuggucaccccauccaugacaaugagaugugugggagugggaaacagagauuuuguggaaggucugucaggagcuacguggauugacguggugcuagagcacggggggugugugaccaccauggcuaagaacaagcccacgcuggauauagagcuucagaagaccgaggccacccaacuggcgacucuaaggaagcuaugcauugaggggaaaauuaccaacauaacaacugacucaagauguccuacccaaggggaagcaguuuugccugaggagcaggaccagaacuacguguguaagcaugcauacguagacagaggcugggggaacgguuguggucuguuuggcaagggaagcuugguaacaugugcgaaauuucaaugccuggaaccgauagagggaaaaguggugcaauaugagaaccucaaauacaccgucaucauuacagugcacacaggagaccaacaccaggugggaaaugaaacgcagggagucacggcugagauaacgccucaggcaucaacuacugaagcuaucuugccugaauauggaacccuugggcuagaaugcucaccacggacaggucuggauuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaaguaguuguccuuggaucgcaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguauaagaaaggaagcucuauuggaaaaauguucgaggccacugccagaggugcaaggcgcauggccaucuugggagacacagcuugggacuuuggaucagugggugguguucugaacucauuaggcaaaauggugcaccaaauauucggaagugcuuacacagcccuguucaguggagucucuugggugaugaaaauuggaauagguguccucuugacuuggauaggauugaauucaaagaauacauccaugucauuuucaugcauugcgauaggaaucaucacacucuaucugggagcugugguacaagcugacauggggugugucguaaauuggaaaggcaaagaacuuaaauguggaaguggaauuuucgucaccaacgagguccauaccuggacagagcaguacaaauuccaagcggauuccccaaaaagauuggcgacagcuauugcaggugcuugggaaaauggagugugcggaauuaggucaacaaccagaauggagaaucuuuuguggaagcaaauagccaaugaacugaacuacauauuaugggaaaacaacaucaaauuaacgguaguugugggcgacacaauuggggucuuagagcaaggaaaaagaacacuaacaccacaacccauggagcuaaaauacucauggaaaacguggggaaaggcaaaaauagugacagcugagacacaaaauuccucuuucauaauagacgggccaaacacaccggaauguccaagugccucaagagcauggaaugugugggagguggaagauuacggguucggagucuucacaaccaacauauggcugaaacuccgagagguguacacccaaaugugugaccauaggcuaaugucggcagccgucaaggaugagagggccgugcaugccgacaugggcuacuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacaagaggcccaucauugagaacgacaacagugucaggaaaguugauacacgaaugguguugccgcucgugcacacuuccuccucugcgauacaugggagaagacggcuguugguauggcauggaaaucagacccaucagugagaaagaagagaacaugguaaagucuuuagucucagcgggaaguggaaagguagacaacuucacaaugggugucuuguguuuggcaauccucuuugaagaggugaugagaggaaaauuugggaagaaacacaugauugcagggguuuucuucacguuugugcuccuccucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagaaaauuuacuguuaggagucggacuggcuauggcaacaacguuacaauugccagaggacauugaacaaauggcaaauggaaucgcccuggggcucauggcucuuaaauugauaacacaauuugaaacauaccaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuggccaguucucuccuuagaaaugacgugcccauggcuggaccauuaguggccgggggcuugcugauagcgugcuacgucauaacuggcacgucagcagaccucacaguagaaaaagcagcagauguaacaugggaggaagaggcugagcaaacaggagugucccacaacuuaaugaucacuguugaugaugauggaacaaugagaauaaaagaugaugagacugagaauauuuuaacagugcuuuugaagacagcauuacuaauaguaucagguaucuuuccauacuccauacccgcaacauugcuggucuggcauacuuggcaaaagcaaacccaaagauccgguguucuaugggacguacccagccccccagagacacagaaagcagaacuggaagaaggggucuauaggaucaagcagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggagaggaggugcagguuauugccguagagccugggaagaacccaaagaacuuucaaaccaugccaggcacauuucagacuacaacaggggaaauaggagcaauugcacuggauuucaagccuggaaccucagggucuccuaucauaaacagagagggaaagguagugggacuauauggcaauggaguggucacaaagaauggcggcuacgucagcggaauagcgcaaacaaaugcagaaccagauggaccgacgccagaguuggaagaagaaauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaaccgcaacaaaaucugaacacacgggaagagagauuguugaucuaaugugccacgcaacguucacaaugcgcuugcugucaccaguuaggguuccaaacuauaacuugauaauaauggaugaggcccauuucacagacccagccaguauagcggccagaggguacauaucaacucguguuggaaugggagaggcagccgcaauuuuuaugacggcaacgcccccuggaacagcugaugccuuuccucagagcaacgcuccaauucaagaugaagaaagggacauaccagaacgcucauggaauucaggcaaugaauggauuaccgacuuugccggaaaaacggugugguuuguccccagcaucaaagccggaaaugacauagcaaacugcuugcgaaagaacgggaaaaaggucauucaacuuaguaggaagacuuuugaaacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaauguugcuggauaacaucaacacuccagaaggaaucauaccagcucucuuugaaccagaaagggagaagucagccgccauagacggugaauaucgccugaaaggugaauccaggaagacuuucguagaacucaugaggaggggugaccuuccaguuugguuagccuacaaaguagcaucagaagggaucaaauauacagauagaaaauggugcuuugauggacaacgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcuggcagaaagucgaucgcccuugaucuugugacagaaauaggaagagugccuucacaccuagcccacagaacgagaaacgcucuggacaaucuggugaugcugcacacgucagaacauggugguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggcugaaauuccucuccaauggaucgcgucggcuauaguccuggaguuuuuuaugaugguguugcuuauaccagaaccagaaaagcagagaaccccccaagacaaccaacucgcauaugucguaauaggcauacucacauuggcugcgauaauagcggccaaugaaaugggacuguuggaaacuacaaagagagauuuaggaauguccaaggagccagguguuguuucuccaacuagcuauuuggauguggacuugcacccagcaucagcuuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaauuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugcgcaguucaacuguuguuaaugagaacaucaugggccuugugugaagcucuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuuaggagaaaaauggaaaaagaaauugaaucaguugucccggaaagaguuugaccuuuacaagaagucuggaaucacugaaguggauagaacagaagccaaagaaggguugaaaagaggagaaacaacacaucaugccgugucgagagguagugcaaaacuucaaugguuuguggagagaaacauggucauucccgaaggaagagucauagaccugggcuguggaagaggaggcuggucauauuacugugcaggacugaaaaaagucacagaagugcgaggguacacaaaaggcgguccaggacacgaagaaccagugccuauggcaacauauggauggaacauaguuaaguuaaugaguggaaaggauguguucuaucuuccaccugaaaagugugacacccuguugugugacauuggagaauccucaccaagcccaacaguggaagaaagcagaacuauaagaguucugaagaugguugaaccauggcugaaaaacaaccaguuuugcauuaaaguauugaacccuuacaugccagccgugauugagcaccuagaaagacuacaaaggaaacacggaggaaugcuugugagaaauccacuuucacgaaacuccacgcacgaaauguacuggauaucuaaugguacagguaacauugucucuucagucaacaugguauccagauuguuacugaacagguucacgaugacacacaggagaccuaccauagagaaagacguggauuuaggagcaggaacucgacaugucaaugcggaaccagaaacacccaacauggaugucauuggggaaagaauaaaaaggaucaaagaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagacacaacuccauuuggccagcagagagucuuuaaagagaaaguggacaccaggacacccaggccuaugccagggacaagaaagguuauggagaucacagcggaguggcucuggagaacccugggaaggaacaaaagacccagguuaugcacaagggaagaguucacaaaaaagguuagaacuaacgcagccaugggcgccguuuucacagaggagaaccaaugggacagugcgaaagcugcuguugaggaugaagaauuuuggaaacuuguggacagagaacgugaacuccacaaacuaggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuugaaugaagaccacugguucucgcgugaaaacucuuacaguggaguagaaggagaaggacugcacaaacuaggcuacauauuaagggacauuuccaagauacccggaggagccauguaugcugaugacacagcugguugggacacaagaauaacagaagaugaccugcacaaugaggaaaagaucacucagcaaauggacccugaacacaggcuguuagcgaacgccauauuuaagcucacauaccaaaacaaaguggucaaaguccaacgaccgacuccaacgggcacgguaauggacaucauaucuaggaaagaccaaagaggcaguggacaggugggaacuuauggucugaacacauuuaccaacauggaagcccaguuagucaggcaaauggaaggagaaggugugcugucaaaggcagaccucgagaacccucaucugccagaaaagaaaaucacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauuaaucaugaaagauggaagaaaguuggugguucccugcagaccccaggacgaacuaauaggaagagcgagaaucucucaaggagcgggauggagucuuagagaaaccgcauguuuggggaaagccuacgcccaaauguggagucucauguauuuucacagaagagaucucagacuagcguccaaugccauauguucagcaguaccaguccacuggguccccacaaguagaacgacauggucuauucaugcucaccaucaguggaugaccacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucacuuccagagcaaccugggcccagaacauacccacagcaauucaacaggugagaagccuuauaggcaaugaagaguuucuagacuacaugccuucaaugaagagauucaggaaagaggaggagucggagggagccauuugguaa

SEQ ID NO: 7737 - RNA, 9873 nt, Artificial Sequence
  derived and/or modified CDS sequence (wt) from DENV-3__GU370053__SS-prME
acaucacucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggauuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggauuggacacacgcacccaaaccuggaugucggcugaaggagcuuggagacaagucgagaagguagagacaugggcccuuaggcacccaggguuuaccauacuagcccuauuucucgcccauuacauaggcacuuccuugacccagaaggugguuauuuucauauuauuaauguuggucaccccauccaugacaaugagaugugugggaguaggaaacagagauuuuguggaagggcuaucaggagcuacguggguugacguggugcucgagcacggggggugugugacuaccauggcuaagaacaagcccacgcuggauauagagcuucagaagaccgaggccacccaacuggcgacccuaagaaagcuaugcauugaggggaaaauuaccaacauaacaacugacucaagaugucccacccaaggggaagcgguuuugccugaggagcaggaccagaacuacguguguaagcauacauacguggacagaggcugggggaacgguugugguuuguuuggcaaaggaagcuugguaacaugugcgaaauuucaaugccuggaaccaauagagggaaaaguggugcaauaugagaaccucaaauacaccgucaucauuacagugcacacaggagaccaacaccaggugggaaaugaaacgcaaggagucacggcugagauaacaccucaggcaucaaccacugaagccaucuugccugaauauggaacccuugggcuagaaugcucaccacggacagguuuggauuucaaugaaaugaucuuacuaacaaugaagaacaaagcauggaugguacacagacaaugguucuuugaccuaccucuaccaugggcaucaggagcaacaacagaaacaccaaccuggaacaggaaggagcuucuugugacauucaagaacgcacaugcgaaaaaacaagaaguaguuguucuuggaucgcaagagggagcaaugcauaccgcacugacaggagcuacagaaauccaaaacucaggaggcacaagcauuuucgcggggcacuuaaaauguagacuuaagauggacaaauuggaacucaaggggaugagcuaugcaaugugcacgaauaccuuuguguugaaaaaagaagucucagaaacgcagcacgggacaauacucauuaagguugaguacaaaggggaagaugcaccuugcaagauucccuuuuccacagaggauggacaagggaaagcucacaauggcagacugaucacagccaacccuguggugacuaagaaggaggagcccgucaauauugaggcugaaccuccuuuuggggaaagcaauauaguaauuggaauuggagacaacgccuugaaaaucaacugguacaagaaggggagcucgauugggaagauguucgaggccacugccaggggugcaaggcgcauggccaucuugggagacacagcuugggacuuuggaucaguggguggcguucugaauucauuaggcaaaauggugcaccaaauauuuggaagugcuuauacagcccuguucaguggagucucuugggugaugaaaauuggaauagguguccucuugacuuggauaggguugaauucaaaaaacacauccaugucauuuucaugcauugcgauaggaaucauuacacucuaucugggagcugugguacaagcugacauggggugugucauaaacuggaaaggcaaagaacucaaaugcggaagcggaauuuucgucaccaaugagguccauaccuggacagagcaauacaaauuccaagcagacuccccaaaaagauuggcaacagccauugcaggcgcuugggagaauggaguguguggaauuaggucaacaaccagaauggagaaccucuuguggaagcaaauagccaaugaacugaacuacauauuaugggaaaacaauaucaaauuaacaguaguugugggcgauacaauuggggucuuagagcaagggaagagaacacuaacaccacaacccauggagcuaaaauacucauggaaaacguggggaaaggcgaaaauagugacagcugaaauacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacaugccgacaugggcuacuggauagaaagccaaaagaauggaaguuggaagcuagaaaaagcaucccucauagagguaaaaaccugcacauggccaaaaucacacacucucuggaguaauggugugcuagagagugacaugaucaucccaaagagucuagcugguccuaucucacaacacaacuacaggcccggguaccacacccaaacggcaggacccuggcacuuaggaaaauuggagcuggacuucaacuacugugaaggaacaacaguugucaucacagaaagcuguggaacaagaggcccaucauugagaacaacaacagugucagggaaguugauacacgaaugguguugccgcucgugcacacuucccccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuaugaagaggugaugagaggaaaauuugggaagaaacacaugauugcagggguuuucuuuacguuugugcuccuucucucagggcaaauaacauggagagacauggcgcacacacuaauaaugauuggguccaacgccucugacaggaugggaaugggcgucaccuaccuagcucuaauugcaacauuuaaaauccaaccauucuuggcuuugggauuuuuccuaagaaagcugacaucuagagaaaauuuauugcuaggaguuggguuggccauggcaacaacguuacaacugccagaggacauugaacaaauggcaaauggaaucgcucuggggcucauggcucuuaaacugauaacacaauuugaaacauaccaauuguggacggcauuagucuccuuaacguguucaaacacaauuuuuacguugacuguugccuggagaacagccacucugauuuuggccggaguuucgcuuuuaccagugugccagucuucaagcaugaggaaaacagauuggcucccaauggcaguggcagcuaugggaguuccaccccuuccacuuuuuauuuuuagcuugaaagacacacucaaaaggagaagcuggccgcugaaugagggggugauggcuguugggcuugugagcauucuggccaguucccuccuuagaaaugaugugcccauggcuggaccauuaguggccgggggcuugcugauagcgugcuacgucauaacuggcacgucagcagaccucacuguagaaaaagcagcagauguaacaugggaggaagaggcugagcagacaggagugucccacaacuuaaugaucacaguugaugaugauggaacaaugagaauaaaagaugaugagacugagaacauccuaacagugcuuuuaaaaacagcauuauuaauaguaucaggcauuuuuccauacuccauacccgcaacauuguuggucuggcacacuuggcaaaaacaaacccaaagauccggcguuuuaugggaugugcccagccccccagagacacagaaagcagaacuggaagaagggguuuauaggaucaaacagcaaggaauuuuugggaaaacccaaguagggguuggaguacagaaagaaggagucuuccacaccauguggcacgucacaagaggggcaguguugacacauaaugggaaaagacuggaaccaaacugggcuagugugaaaaaagaucugauuucauauggaggaggauggagacugagcgcacaauggcaaaagggggaggaggugcagguuauugccguagagccagggaagaacccaaagaacuuucaaaccaugccaggcacuuuucagacuacuacaggggaaauaggagcaauugcacuggauuucaagccuggaacuucaggaucuccuaucauaaauagagagggaaagguagugggacuguauggcaauggagugguuacaaagaaugguggcuaugucagcggaauagcgcaaacaaaugcagaaccagauggaccgacaccagaguuggaagaagagauguucaaaaagcgaaaccugaccauaauggaucuccauccugggucaggaaagacacggaaauaccuuccagccauugucagagaggcaaucaagagacguuuaagaaccuuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcguuugcugucaccaguuaggguuccaaauuacaacuugauaguaauggaugaggcccauuucacagacccagccagcauagcggcuagaggguacauaucaacucguguuggaaugggagaggcagccgcaaucuucaugacagcaacacccccuggaacagcugaugccuuuccucagagcaacgcuccaauucaagaugaagaaagggacauaccagaacgcucauggaauucaggcaaugaauggauuaccgacuucgcugggaaaacggugugguuugucccuagcauuaaagccggaaaugacauagcaaacugcuugcgaaaaaacgggaagaaggucauucaacuuaguaggaagacuuuugacacagaauaucagaagacuaaacugaaugauugggacuuuguggugacgacugacauuucagaaaugggggccaauuucaaagcagauagagugauugacccaagaagaugucucaaaccagugaucuugacagauggaccagagcgggugauccuggccggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaacacaccagaaggaauuauaccagcucucuuugaaccagaaagggagaagucagccgccauagacggugaguaccgccugaagggugaguccaggaagacuuucguggaacucaugaggaggggugaccuuccaguuugguuagcccauaaaguagcaucagaaggaaucaaauauacagauagaaaauggugcuuugaugggcaacgcaauaaucaaauuuuagaggagaacauggauguggaaaucuggacaaaggaaggagaaaagaaaaaauugagaccuagguggcuugaugcccgcacuuauucagauccauuagcacucaaggaauucaaggacuuugcggcuggcagaaagucaaucgcccuugaucuugugacagaaauaggaagagugccuucacaccuagcccacagaacaagaaacgcuuuggacaaucuggugaugcugcauacgucagaacauggcgguagggcuuacagacaugcgguggaggaacuaccagaaacaauggaaacacuccuacucuugggacuuaugaucuuguugacagguggagcaaugcuuuucuugauaucagguaaagggauuggaaagacuucaauaggacucaucuguguaauugcuuccagcggcauguuguggauggccgaaguuccacuccaauggaucgcgucggcuauaguccuggaguuuuuuaugaugguguugcucauaccagaaccagaaaagcagagaaccccccaagacaaccaacuugcauaugucgugauaggcauacuuacauuggcugcaauaauagcagccaaugaaaugggacuguuggaaaccacaaagagagacuuaggaaugucuaaggagccagguguuguuucuccaaccagcuauuuggauguggacuugcacccagcaucagccuggacauuguacgccguggccacuacaguaauaacaccaauguuaagacacaccauagagaauucuacagcaaaugugucccuggcagcuauagccaaccaggcagugguucugauggguuuggacaaaggauggccaauaucaaaaauggacuugggcgugccacuacuagcacuggguugcuauucacaagugaacccacugacucuaacugcggcaguacuuuugcuaaucacacauuaugcuaucauagguccaggauugcaagcaaaagccacccgugaagcucagaaaaggacagcugcuggaauaaugaagaauccaacgguggaugggauaaugacaauagaccuagauccuguaauauaugauucaaaauuugaaaaacaacugggacaggucaugcuccugguuuugugcgcaguccaacuuuugcuaaugagaacaucaugggccuugugugaagcuuuaacccuagcuacaggaccaauaacaacacucugggaaggaucaccugguaaguuuuggaacaccacgauagcuguuuccauggcgaacauuuuuagagggagcuaucuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaaaaaaucuggaaucacugaaguggauagaacagaagccaaagaaggguugaaaagaggagagacaacacaucaugccguguccagagguagcgcaaaacuucaaugguuuguggaaagaaacauggucguucccgaaggaagagucauagacuugggcuguggaagaggaggcuggucauauuacugugcaggacugaaaaaagucacagaagugcgaggauacacaaaaggcgguccaggacacgaagaaccaguaccuaugucuacauauggauggaacauaguuaaguuaaugagcggaaaggauguguucuaucucccaccugaaaagugugauacccuguugugugacauuggagaaucuucaccaagcccaacaguggaagagaguagaacuauaagaguuuugaagaugguugaaccauggcuaaaaaacaaccaguuuugcauuaaaguuuugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaacauggugucuagauugcuacugaacagguucacgaugacacacaggagacccaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuucucacuaaaccaugggauguggugcccauggugacacagauggcaaugacagacacaacuccauuuggccagcagagagucuuuaaagagaaaguggacaccaggacgcccaggcccaugccagggacaagaaagguuauggaaaucacagcggaguggcucuggagaacccugggaaggaacaaaagacccagguuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuauaacaugauggguaagagagagaaaaaacuuggagaguuuggcaaagcgaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucauacagcaaauggacccugaacacaggcaguuagcgaacgcuauauucaagcucacauaccaaaacaaaguggucaaaguucaacgaccgacuccaacggguacgguaauggauauuauaucuaggaaagaccaaaggggcaguggacaagugggaacuuauggccugaacacauucaccaacauggaagcccaguuagucagacaaauggaaggagaaggugugcugacaaaggcagaccucgagaacccucaucugccagagaagaaaauuacacaaugguuggaaaccaaaggaguggagagguuaaaaagaauggccauuagcggagaugauugcguggugaaaccaaucgaugauagguucgcuaaugcucugcuugcccugaacgauaugggaaagguucggaaagacauaccccaauggcagccaucaaggggauggcaugauuggcaacaggucccuuucugcucccaccacuuucaugaauugaucaugaaagauggaagaaaguuagugguucccugcagaccccaggacgaacuaauaggaagagcaagaaucucucaaggagcgggauggagccuuagagaaacugcaugucuggggaaagccuacgcccagauguggagucucauguauuuucacagaagagaucucagauuagcauccaacgccauauguucagcaguaccaguccacuggguucccacaaguagaacgacauggucuauucaugcucaccaucaguggaugacuacagaagacaugcuuacuguuuggaacaggguguggauagaggaaaauccauggauggaagacaaaacuccaguuacaacuugggaaaauguuccauaucuagggaagagagaagaccaaugguguggaucacuuauuggucucacuuccagagcaaccugggcccagaacauacucacagcaauucaacaggugagaagccuuauaggcaaugaagaguuccuggacuauaugccuucaaugaagagauucaggaaggaagaggagucggagggagccauuugguaa

SEQ ID NO: 7738 - RNA, 9873 nt, Artificial Sequence
  derived and/or modified CDS sequence (wt) from DENV-3__JQ411814__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaauuaacaugugcacacucauagccauggacuugggagagaugugugaugacacggucacuuacaaaugcccccacauuaccgaaguggagccugaagacauugacugcuggugcaaccuuacaucaacaugggugacuuauggaacgugcaaucaagcuggagagcauagacgcgacaaaagaucaguggcguuagcuccucaugucggcaugggacuggacacacgcacccaaaccuggaugucggcugaaggagcuuggagacaagucgagaagguagagacaugggcccucaggcacccaggguucaccauacuagcccuauuucuugcccauuacauaggcacuuccuugacccagaaggugguuauuuuuauacuacuaaugcuggucaccccauccaugacaaugagaugugugggaauaggaaacagagauuuuguggaaggucuaucaggagcuacguggguugacguggugcucgagcacggggggugugugacuaccauggcuaagaacaagcccacgcuggauauagagcuucagaagaccgaggccacccaacuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacgguuguggcuuguuuggcaagggaagcuugguaacgugugcgaaauuucaaugccuggaaccaauagagggaaaaguggugcaauaugagaaccucaaauacaccgucaucauuacagugcacacaggagaccaacaccagguaggaaaugaaacgcagggagucacggcugagauaacaccucaggcaucaaccacugaagccaucuugccugaauauggaacccuugggcuagaaugcucaccacggacagguuuggauuucaaugaaaugaucuuacuaacaaugaagaacaaagcauggaugguacauagacaaugguuuuuugaccuaccucuaccauggacaucaggagcuacaacagaaacgccaaccuggaacaggaaggagcuucuugugacauucaaaaacgcacaugcgaaaaaacaagaaguagucguccuuggaucgcaagagggagcaaugcauaccgcacugacaggagccacagaaauccaaaacucaggaggcacaagcauuuuugcggggcacuuaaaauguagacuuaagauggacaaauuggaacucaaggggaugagcuaugcaaugugcacgaauaccuuuguguugaagaaagaagucucagaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccugucaauauugaggcugaaccuccuuuuggggaaaguaauauaguaauuggaauuggagacaacgccuugaaaaucaacugguacaagaagggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuugggugaugaaaauuggaauagguguucucuugacuuggauaggguugaauucaaaaaacacauccaugucauuuucaugcauugcgauaggaaucauuacacucuaucugggagcugugguacaagcugacauggggugugucauaaacuggaaaggcaaagaacucaaauguggaaguggaauuuucgucaccaacgagguccauaccuggacagagcaauacaaauuccaagcagacuccccaaaaagauuggcgacagccauugcaggcgcuugggagaauggagugugcggaauuaggucaacaaccagaauggagaaucucuuguggaagcaaauagccaaugaacugaacuacauauuaugggaaaacaauaucaaauuaacgguaguugugggcgauacaauuggggucuuagagcaaggaaaaagaacacuaacaccacaacccauggagcuaaaauacucauggaaaacauggggaaaggcaaaaauagugacagcugaaacacaaaauuccuccuucauaauagacgggccaaacacaccggaguguccaagugccucaagagcauggaaugugugggagguggaagauuacggguucggagucuucacaaccaacauauggcugaaacuccgagauguguacacccaacuaugugaccauaggcuaaugucggcagccgucaaggaugagagggccguacacgccgacaugggcuauuggauagaaagccaaaagaauggaaguuggaagcuagaaaaagcaucccucauagaggugaaaaccugcacauggccaaaaucacacacucuuuggagcaauggugugcuagagagugacaugaucaucccaaagagucuagcugguccuauuucgcaacacaacuacaggccuggguaccacacccaaacagcaggacccuggcacuuaggaaaauuggagcuggacuucaacuauugugaaggaacaacaguugucaucacagaaaacugugggacaagaggcccaucauugagaacaacaacagugucagggaaguugauacacgaaugguguugccgcucgugcacacuuccuccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcagggguucucuucacguuugugcuccuucucucagggcaaauaacauggagagacauggcgcacacacuaauaaugauuggguccaacgccucugacaggaugggaaugggcgucaccuaccuagcuuuaauugcaacauuuaaaauccagccauucuuggcuuugggauuuuuccuaagaaaacugacaucuagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacggcauuagucuccuuaacguguucaaauacaauucuuacguugacuguugccuggagaacagccacccugauuuuggccggaguuucgcuuuuaccagugugccagucuucgagcaugaggaaaacagacuggcuuccaaugacaguggcagcuaugggaguuccaccccuaccacuuuuuauuuuuagcuugaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcagaccucacuguggaaaaagcagcagauguaacaugggaggaagaggcugagcaaacaggagugucccacaacuuaaugaucacaguugaugaugauggaacaaugagaauaaaagaugaugagacugagaacauccuaacagugcuuuuaaaaacagcauuacuaauaguaucaggcaucuuuccauacuccauacccgcaacauuguuggucuggcauacuuggcaaaagcaaacccaaagguccggcguucugugggacguacccagccccccagagacacagaaagcagaacuggaagaagggguuuauaggaucaaacagcaaggaauucuugggaaaacccaaguagggguuggaguacagaaagaaggagucuuccacaccauguggcacgucacaagaggggcaguguugacacauaaugggaaaagacuggaaccaaacugggcuagcgugaaaaaagaucugauuucauacggaggaggauggagauugagcgcgcaauggcaaaagggggaggaggugcagguuauugccguggagccugggaagaacccaaagaacuuucaaaccaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacaaaugcagaaccagauggaccgacaccagaguuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgcuugcugucaccaguuaggguuccaaauuauaacuugauaauaauggaugaggcccauuucacagacccagccagcauagcggcuagaggguacauaucaacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauuaccgacuucgcugggaaaacggugugguuuguccccagcauuaaagccggaaaugacauagcaaacugcuugcggaaaaacgggaaaaaggucauucaacuuaguaggaagacuuuugacacagaauaucagaagacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagaggaagaguuggcaggaacccacaaaaagaaaaugaccaguacauauucacgggccagccucucaacaaugaugaagaccaugcucacuggacagaagcaaaaaugcugcuggacaacauuaacacaccagaagggauuauaccagcucucuuugaaccagaaagggagaagucagccgccauagacggugaguaucgccugaagggugaguccaggaagacuuucguggaacucaugaggaggggugaccuuccaguuugguuagcccauaaaguagcaucagaagggaucaaauauacagauagaaaauggugcuuugauggacaacgcaauaaucaaauuuuagaggagaacauggauguggaaaucuggacaaaggaaggagaaaagaaaaaauugagaccuagguggcuugaugcccgcacuuauucagaucccuuagcacucaaggaauuuaaggacuuugcggcuggcagaaagucaaucgcccuugaucuugugacagaaauaggaagagugccuucacaccuagcccacagaacgagaaacgcucuggacaaucuggugaugcugcauacgucagaacauggcgguagggccuacaggcaugcgguggaggaacuaccagaaacaauggaaacacucuuacucuugggacucaugaucuuguugacagguggagcaaugcuuuucuugauaucaggaaaagggauuggaaagacuucaauaggacucauuuguguaauugccuccagcggcauguuguggauggccgaaaucccacuccaguggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagccaaugaaaugggacuguuggaaacuacaaagagagauuuaggaaugucuaaggagccagguguuguuucuccaaccagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccacugacucuaacagcggcaguacuuuugcuaaucacacauuaugcuauuauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccuggaaaguuuuggaacaccacgauagcuguuuccauggcgaacauuuuuagagggagcuauuuagcaggagcugggcuugcuuuuucuauuaugaaaucaguuggaacaggaaaaagaggaacagguucacaaggcgaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauacuacugugcaggacugaaaaaagucacagaagugcgaggauacacaaaaggcgguccaggacacgaagaaccaguaccuaugucuacauauggauggaacauaguuaaguuaaugaguggaaaggauguguuuuaucuuccaccugaaaagugugauacccuguugugugacaucggagaaucuucaccaagcccaacaguggaagaaagcagaacuauaagaguuuugaagaugguugaaccauggcuaaaaaacaaccaguuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaacaugguaucuagauugcuacugaacagguucacgaugacacacaggagaccuaccauagagaaagauguggauuuaggagcaggaacucgacauguuaaugcggaaccagaaacacccaacauggaugucauuggggaaagaauaaaaaggaucaaggaggagcacaauucaacauggcacuaugaugacgaaaaccccuacaaaacgugggcuuaccauggauccuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccaggcccaugccagggacaagaaagguuauggggaucacagcggaguggcucuggagaacccugggaaggaacaaaagacccagguuaugcacaagggaagaguuuacaaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugacaacucuuacaguggaguagaaggagaaggacugcacaagcuaggcuacauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucugaauacauucaccaacauggaaguccaguuagucagacaaauggaaggagaaggugugcugucaaaggcagaccucgagaacccucaucugccagagaagaaaauuacacaaugguuggaaaccaaaggaguggagagguuaaaaagaauggccauuagcggggaugauuguguagugaaaccaaucgaugacagguucgcuaaugcccugcuugcucugaacgauaugggaaagguucggaaagacauaccucaauggcagccaucaaagggauggcaugauuggcaacagguuccuuucugcucccaccacuuucaugaauugaucaugaaagauggaagaaaguuagugguucccuguagaccccaggacgaacuaauaggaagagcaagaaucucucaaggagcgggauggagccuuagagagaccgcaugucuggggaaagccuacgcucaaauguggagucucauguacuuucacagaagagaucucagacuagcauccaacgccauauguucagcaguaccaguccacuggguccccacaaguagaacgacauggucuauucaugcucaccaucaguggaugacuacagaagacaugcuuacugucuggaacaggguguggaucgaggacaauccauggauggaagacaaaacuccaguuacaaccugggaaaauguuccauaucuagggaagagagaagaccaauggugcggaucacuuauuggucucaccuccagagcaaccugggcccagaacauacccacagcaauucaacaggugagaagccuuauaggcaaugaagaguuucuggauuacaugccuucaaugaagagauucaggaaggaggaggagucggaaggagccauuugguaa

SEQ ID NO: 7739 - RNA, 9873 nt, Artificial Sequence
  derived and/or modified CDS sequence (wt) from DENV-3__KM190937__SS-prME
acaucgcucugucucaugaugauguuaccagcaacacuugcuuuccacuuaacuucacgagauggagagccgcgcaugauuguggggaagaaugaaagaggaaaaucccuacuuuucaagacagccucuggaaucaacaugugcacacucauagcuauggaucugggagagaugugugaugacacggucacuuacaaaugcccccacauuaccgaaguggagccugaagacauugacugcuggugcaaccuuacaucgacaugggugacuuauggaacaugcaaucaagcuggagagcauagacgcgauaagagaucaguggcgauagcuccccauguuggcaugggacuggacacacgcacucaaaccuggaugucggcugaaggagcuuggagacaagucgagaagguagagacaugggcccuuaggcacccaggguuuaccauacuagcccuauuucuugcccauuacauaggcacuuccuugacccagaaagugguuauuuuuauacuauuaaugcugguuaccccauccaugacaaugagauguguaggaguaggaaacagagauuuuguggaaggccuaucgggagcuacguggguugacguggugcucgagcacggugggugugugacuaccauggcuaagaacaagcccacgcuggacauagagcuucagaagaccgaggccacccaacuggcgacccuaaggaagcuaugcauugagggaaaaauuaccaacauaacaaccgacucaagaugucccacccaaggggaagcgauuuuaccugaggagcaggaccagaacuacguguguaagcauacauacguggacagaggcuggggaaacgguugugguuuguuuggcaagggaagcuuggugacaugcgcgaaauuucaauguuuagaaucaauagagggaaaaguggugcaacaugagaaccucaaauacaccgucaucaucacagugcacacaggagaccaacaccaggugggaaaugaaaugcagggagucacggcugagauaacaccccaggcaucaaccgcugaagucauuuuaccugaauauggaacccucgggcuagaaugcucaccacggacagguuuggauuucaaugaaaugaucucauugacaaugaagaacaaagcauggaugguacauagacaaugguucuuugacuuaccccuaccauggacaucaggagcuacagcagaaacaccaacuuggaacaggaaagagcuucuugugacauuuaaaaaugcacaugcaaaaaagcaagaaguaguuguucuuggaucacaagagggagcaaugcauacagcacugacaggagcuacagagauccaaaccucaggaggcacaaguaucuuugcggggcacuuaaaauguagacucaagauggacaaauuggaacucaaggggaugagcuaugcaaugugcuugaguagcuuuguguugaagaaagaagucuccgaaacgcagcaugggacaauacucauuaagguugaguacaaaggggaagaugcacccugcaagauuccuuucuccacggaggauggacaaggaaaagcucacaauggcagacugaucacagccaauccaguggugaccaagaaggaggagccugucaacauugaggcugaaccuccuuuuggagaaaguaacauaguaauuggaauuggagacaaagcccugaaaaucaacugguacaagaagggaagcucgauugggaagauguucgaggccacugccagaggugcaaggcgcauggccaucuugggagacacagccugggacuuuggaucagugggugguguuuugaauucauuagggaaaaugguccaccaaauauuugggagugcuuacacagcccuauuugguggagucuccuggaugaugaaaauuggaauagguguccucuuaaccuggauaggguugaacucaaaaaauacuucuaugucauuuucaugcaucgcgauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcagacucccccaagagacuggcaacagccauugcaggcgcuugggaaaauggagugugcggaauuaggucaacaaccagaauggagaaccucuuguggaagcaaauagccaaugaacugaauuacauauuaugggaaaacaacauuaaauuaacgguaguuguaggcgacauaacuggggucuuagagcaagggaaaagaacacuaacaccacaacccauggagcuaaaauauucuuggaaaacauggggaaaggcaaaaauagugacagcugaaacacaaaauuccucuuucauaauagaugggccaagcacaccggaguguccaagugccucaagagcauggaaugugugggagguggaggauuacggguucggaguuuucacaaccaacauauggcugaaacuccgagagguguacacccaacuaugugaccauaggcuaaugucggcagccgucaaggaugagagggcuguacaugccgacaugggcuauuggauagaaagccaaaagaaugggaguuggaagcuagaaaaagcauccuucauagaggugaaaaccugcacauggccaaaaucacacacucucuggagcaauggugugcuagagagugacaugauuaucccaaagagucuagcuggucccauuucgcaacacaaccacaggcccggguaccacacccaaacggcaggacccuggcacuuaggaaaauuggagcuggacuucaacuauugugaaggaacaacaguugucaucucagaaaacugugggacaagaggcccaucauugagaacaacaacggugucagggaaguugauacacgaauggugcugccgcucgugcacacuuccuccccuacgauacaugggagaagacggcugcugguauggcauggaaaucagacccauuaaugagaaagaagagaauaugguaaagucucuagccucagcagggaguggaaagguggacaacuucacaaugggugucuuguguuuggcaauccucuuugaagaggugaugagaggaaaauuugggaaaauacacaugauugcagggguucucuucacguuugugcuccuccucucagggcaaauaacauggagagacauggcgcacacacucauaaugauuggguccaacgccucugacagaauggggaugggcgucacuuaccuagcucuaauugcaacauuuaaaauucagccauuccuggcuuugggauucuuccugaggaaacugacaucuagagaaaauuuauugcugggaguuggguuggccauggcagcaacguuacgacugccagaggacauugaacagauggcgaauggaauugcuuuggggcucauggcucuuaaacugauaacacaauuugaaacauaccaacuauggacggcauuaguuucccuaacguguucaaauacaauuuucacguugacuguugccuggagaacagccacucugauuuuagccggaauuucgcuuuugccagugugccagucuucgagcaugaggaaaacagauuggcucccaaugacuguggcagcuaugggagcucaaccccuaccacuuuuuauuuucagucugaaagauacacucaaaaggagaagcuggccacugaaugagggggugauggcaguuggacuugugagcauucuagcuaguucucuccuuaggaaugaugugccuauggcuggaccauuaguggcugggggcuugcugauagcgugcuacgucauaacuggcacgucagcagaccucacuguagaaaaagcagcagauguaacaugggaggaagaggccgagcaaacaggagugucccacaauuuaauggucacaguugaugaugauggaacaaugagaauaaaagaugacgagacugagaacaucuuaacagugcuuuuaaaaacagcacuacuaauaguaucaggcaucuuuccauacuccauacccgcaacacuguuggucuggcauacuuggcaaaagcaaacccaaagauccggcguccuaugggacguacccagccccccagagacacagaaagcggaacuggaagaaggggucuauaggaucaaacagcaaggaauuuuugggaaaacccaaguggggguuggaguacagaaagaaggaguuuuccacaccauguggcaugucacaagaggggcaguguugacacacaaugggaaaagacuggaaccaaacugggcuagcgugaaaaaagaucugauuucauacggaggaggauggagauugagugcacaauggcaaaagggggaggaggugcagguuauugccguagagccugggaagaacccaaagaacuuucaaaccaugccaggcauuuuucagacaacaacaggggaaauaggagcaauugcacuggauuucaagccuggaacuucaggaucucccaucauaaacagagagggaaagguagugggacuguauggcaauggagugguuacaaagaauggaggcuaugucaguggaauagcgcaaacaaaugcagaaccagauggaccgacaccagaguuggaagaagagauguucaaaaagcgaaaucuaaccauaauggaucuccauccugggucaggaaagacgcggaaauaucuuccagcuauuguuagagaggcaaucaagagacgcuuaaggacucuaauuuuggcaccaacaaggguaguugcagcugagauggaagaagcauugaaagggcucccaauaagguaucaaacaacugcaacaaaaucugaacacacaggaagagagauuguugaucuaaugugucacgcaacguucacaaugcgcuugcugucaccagucaggguuccaaacuacaacuugauaauaauggaugaggcccauuucacagacccagccaguauagcggcuagaggguacauaucaacucguguaggaaugggagaggcagccgcaauuuucaugacagcaacacccccuggaacagcugaugccuuuccucagagcaacgcuccaauucaagaugaagagagagacauaccggaacgcucauggaauucaggcaaugaauggauuacugacuuuguugggaagacagugugguuugucccuagcaucaaagccggaaaugacauagcaaacugcuugcggaaaaauggaaaaaagguuauucaacucagcaggaagaccuuugacacagaauaucaaaagaccaaacugaaugauugggacuuuguggugacaacagacauuucagaaaugggagccaauuucaaagcagauagagugaucgacccaagaagaugucucaagccggugauuuugacagauggacccgagcgggugauccuggcuggaccaaugccagucaccguagcgagcgcugcgcaaaggagagggagaguuggcaggaacccacaaaaagaaaaugaccaguacauauucaugggccagccucucaacaaugaugaagaccaugcucacuggacagaagcaaaaaugcugcuggacaacaucaacacaccagaagggauuauaccagcucucuuugaaccagaaagggagaagucagccgccauagacggcgaauaccgccugaagggugaguccaggaagacuuucguggaacucaugaggaggggugaccucccaguuuggcuagcccauaaaguagcaucagaagggaucaaauauacagauagaaaauggugcuuugauggagaacguaauaaucaaauuuuagaggagaauauggauguggaaaucuggacaaaggaaggagaaaagaaaaaacugagaccuagguggcuugaugcccgcacuuauucagauccuuuagcacucaaagaauucaaggauuuugcagcuggcagaaagucaaucgcccuugaucuugugacagaaauaggaagagugccuucacacuuagcccacagaacgagaaacgcccuggauaauuuggugaugcugcacacgucagaacauggcgguagggccuacaggcaugcaguggaggaacuaccagaaacgauggaaacacucuuacuccugggacugaugaucuuguuaacagguggagcaaugcucuucuugauaucagguaaagggauuggaaagacuucaauaggacucauuuguguaauugcuuccagcggcauguuauggauggcugaugucccacuccaauggaucgcaucggcuauaguccuggaguuuuuuaugaugguguugcucauaccagaaccagaaaagcagagaacuccccaagacaaccaacucgcauaugucgugauaggcauacuuacauuggcugcaauaguagcggccaaugaaaugggacuguuggaaacuacaaagagagauuuaggaaugucuaaagaaccagguguuguuucuccaaccagcuauuuggauguggacuugcacccagcaucagccuggacauuguacgccguggccacaacaguaauaacaccaauguugagacacaccauagagaauuccacagcaaaugugucucuggcagccauagcuaaccaggcagugguccugauggguuuagacaaaggauggccgauaucgaaaauggacuugggcguaccacuauuggcacuggguugcuauucacaagugaacccacuaacucuugcagcggcaguacuuuugcuagucacacauuaugcaauuauagguccaggauugcaggcaaaagccacccgugaagcucagaaaaggacagcugcuggaauaaugaagaauccaacgguggauggaauaaugacaauagaccuagauccuguaauauaugauucaaaauuugaaaagcaacuaggacaggucaugcuccugguucugugugcaguccaacuuuuauugaugagaacaucaugggccuugugugaaguucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaaccuuaggagaaaaguggaaaaagaaauuaaaucaguuaucccggaaagaguuugaccuuuacaagaaauccggaaucaccgaaguggauagaacagaagccaaagaaggguuaaaaagaggagaaauaacacaccaugccguguccagaggcagcgcaaaacuucaaugguucguggagagaaacauggucauuccugaaggaagagucauagaccuaggcuguggaagaggaggcuggucauauuacugugcaggacugaaaaaaguuacagaagugcgaggauacacaaaaggcggcccaggacacgaagaaccaguaccuaugucuacauacggauggaacauagucaaguuaaugaguggaaaggauguuuuuuaucugccaccugaaaagugugauacccuauugugugacauuggagaaucuucaccaagcccaacaguggaagaaagcagaaccauaagaguuuugaagaugguugaaccauggcuaaagaacaaccaguuuugcauuaaaguauugaacccauacaugccaacugugauugagcacuuagaaagacuacaaaggaaacauggaggaaugcuugugagaaauccacucucacgaaacuccacgcacgaaauguauuggauauccaaugguacaggcaauaucgucucuucagucaacaugguauccagauugcuacugaacagauucacaaugacacacaggagacccaccauagagaaagauguggaucuaggagcaggaacccgacaugucaaugcggaaccagaaacacccaacauggaugucauuggggaaagaauaaaaaggaucaaagaggagcauaguucaacauggcacuaugaugaugaaaauccuuacaaaacgugggcuuaccauggauccuaugaaguaaaagccacaggcucagccuccuccaugauaaauggagucgugaaacuccucacaaaaccaugggauguggugcccauggugacacagauggcaaugacagauacaacuccauucggccagcaaagaguuuuuaaagagaaaguggacaccaggacaccuaggcccaugccaggaacaagaaagguuauggagaucacagcggaguggcuuuggaggacccugggaaggaacaaaagacccagauuaugcacaagggaggaauucacaaagaaggucagaaccaacgcagcuaugggcgcugucuucacagaagagaaccaaugggacagugcgagagcugcuguugaggacgaagaauuuuggaaacuuguggacagagaacgugaacuccacaaacugggcaaguguggaagcugcguuuacaacaugaugggcaagagagagaaaaaacuuggagaguuugguaaagcaaaaggcaguagggcuauaugguacaugugguugggagccagguaccuugaguucgaggcgcucggauuccucaaugaagaccacugguucucgcgugaaaacucuuacaguggaguagaaggagaaggacugcacaagcugggauacaucuugagagauauuuccaagauacccggaggagccauguaugcugaugacacagccgguugggacacaagaauaacagaagaugaccugcacaaugaggaaaaaaucacacagcagauggacccugaacacaggcagcuagcgaacgcuauauucaagcucacauaccaaaacaaaguggucaaaguccaacgaccaacuccaaagggcacgguaauggacaucauaucuaggaaagaccaaagaggcaguggacaggugggaacuuauggucugaacacauucaccaacauggaagcccagcuaaucagacaaauggaaggagaaggcguguugucaaaggcagaccucgagaacccccauccgcuagagaagaaaauuacacaaugguuggaaacuaaaggaguggaaagguuaaaaagaauggccaucagcggggaugauugcguugugaaaccaaucgacgacagauucgccaaugcccugcuugcccugaacgauaugggaaagguuagaaaggacauaccucaauggcagccaucaaagggauggcaugauuggcaacagguccccuucugcucccaccacuuucaugaauugaucaugaaagauggaagaaaguugguaguucccugcagaccccaggacgaacuaauaggaagagcgagaaucucccaaggagcaggauggagccuuagagaaacugcaugucuagggaaagccuacgcucaaaugugggcucucauguauuuucacagaagagaucuuagacuagcauccaacgccauauguucagcaguaccaguccacuggguccccacgagcagaacgacauggucuauucaugcucaccaucaguggaugacuacagaagacaugcuuacugucuggaacaggguguggauagaggacaauccauggauggaagacaaaacuccagucacaacgugggaagauguuccauaucuagggaagagagaagaccaauggugcggaucacucauaggucucacuuccagagcaaccugggcccagaacauacucacagcaauccaacaggugagaagccucauaggcaaugaagaguuucuggacuacaugccuucgaugaagagauucaggaaggaggaggagucagagggagccauuugguaa

SEQ ID NO: 7740 - RNA, 9873 nt, Artificial Sequence
  derived and/or modified CDS sequence (wt) from DENV-3__JQ920487__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgguaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucgugcacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagauacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuauuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguauauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcugcuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauugucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucucacaguggaguagaaggagaaggacugcauaaacugggauacaucuuaagagauauuuccaagauacccggaggagcuauguaugcugaugacacagcugguugggacacaagaauaacagaagaugaccugcacaaugaggaaaaaaucacacagcaaauggauccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcccaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7741 - RNA, 9873 nt, Artificial Sequence
  derived and/or modified CDS sequence (wt) from DENV-3__JQ920488__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucaucacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcgaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuucuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguucacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccuuaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaaugaaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucguacggaggaggauggaaauugggugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaccagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagaguaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgcgugauccuggcgggaccaaugccagucaccguagcgagcgcugcacaaaggagagggagagucggcaggaacucacaaaaagagaaugaccaauacauauucacgggccagccccuuaauaaugaugaagaccaugcucacuggacagaagcaaaaaugcuguuagacaacauuaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7742 - RNA, 9873 nt, Artificial Sequence
  derived and/or modified CDS sequence (wt) from DENV-3__JQ920489__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauauaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugagacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaagcaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacauuaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaagauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuauugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgugugauccuggcgggaccaaugccagucaccguagcgagcgcugcacaaaggagagggagaguuggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaagggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaauuuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacucacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaauagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaaguacgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacaugaaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauuccuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucccaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaauggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7743 - RNA, 9873 nt, Artificial Sequence
  derived and/or modified CDS sequence (wt) from DENV-3__KF824902__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacgcgcacccagaccuggaugucggcugaaggagcuuggagacaagucgagaagguggagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacggcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuacaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggaggaacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaauuaacugguacaagaagggaagcucgaucgggaagauguucgaggccacugccagaggugcaaggcgcauggccaucuugggagacacggccugggacuuuggaucaguggguggcguucuaaauucauuagggaaaauggugcaccaaauauucggaagugcuuacacagcccuguuugguggaguuucauggauaaugaaaauuggaauagguguccuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuucgucaccaaugagguccacaccuggacagagcaauacaaauuucaagcagacuccccuaaaagacuggcgacggccauugcaggcgcuugggaaaauggaguuugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagagcacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaauguaugggagguggaagauuacggguuuggaguuuucacaaccaauauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaacacacacucuuuggagcaaugguguacuagagagugacaugauuaucccaaagagucuagccggucccauuucgcaacacaaccacaggcccggguaccacacccaaacggcaggacccuggcacuugggaaaauuggagcuggacuucaacuauugugaaggaacaacaguagucaucacagaaaacugugggacaagaggcccaucacugagaacaacaacagugucagggaaguugauacacgaaugguguugccgcucgugcacacucccuccccugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaaacacaugauugcagggguucucuucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaauugcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuacgucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacacuguuggucuggcauacuuggcaaaagcaaacccaaagaucugguguucuaugggauguacccagccccccagagacacagaaagcagaacuggaagagggggucuauaggaucaaacaacaaggaauuuuuggaaaaacccaaguggggguuggaguacagaaagaaggagucuuccacaccauguggcacguuacaagaggggcaguguugacgcacaaugggaaaagacuagaaccaaacugggccagcgugaaaaaagaccugauuucauauggaggaggauggagauugagugcacaauggcaaaagggagaggaggugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagaaggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugugcucaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccucagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaccaguacauauucaugggccagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucagaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuagacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagauccuguaauauacgauucaaaauuugaaaagcaacuaggacagguuaugcuccugguccugugugcaguucaacuuuuguuaaugagaacaucaugggccuugugugaagcucuaacccuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugauacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguacuggauauccaacgguaccggcaacaucgucucuucagucaauaugguauccagauugcuacugaacagauucacaaugacacacagaagacccaccauagagaaagacguagauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcaagagcugcuguugaggacgaggaauucuggaaacuugugggcagagaacgugaacuccacaaauugggcaaguguggaagcugcguuuacaacaugaugggcaagagagagaagaaacuuggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugacuugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7744 - RNA, 9873 nt, Artificial Sequence
  derived and/or modified CDS sequence (wt) from DENV-3__KF824903__SS-prME
acaucgcucugucucaugaugauguuaccagcaacacuugcuuuccacuugacuucacgcgauggagagccgcgcaugauuguggggaagaaugaaagagggaaaucccuacuuuuuaagacggcuucuggaaucaacauguguacacucauagccauggacuuaggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguagcguuagcuccccaugucggcaugggacuggacacgcgcacccagaccuggaugucggcugaaggagcuuggagacaagucgagaagguggagacaugggcucuuaggcacccaggguucaccauacuagcucuauuucuagcccauuacauaggcacuucccugacccagaaagugguuauuuuuauacuacuaaugcuggucacuccauccauggcuaugagaugcgugggaguaggaaacagagauuuuguggaaggucugucgggagcuacauggguugauguggugcucgagcacggugggugugugaccaccauggcuaagaacaagcccacgcuggacauagagcuucagaagaccgaggccacucaacuggcgacccuaaggaaauuaugcauugaggggaaaauaaccaacauaacaacugacucaagguguccuacccagggggaagcgauuuuaccugaggagcaggaccagaacuacguauguaagcacacuuacguggauagagguuggggaaacgguugugguuuguuuggaaaaggaaguuuggugacaugcgcaaaauuucaaugucuagaaucaauagagggaaaaguggugcaacaugagaaccucaaauacacugucaccauuacagugcacacaggagaccaacaccaggugggaaaugacacgcagggagucacggcugagauaacaccccaggcaucaaccguugaagcuauccugccugaauauggaacccuugggcuagaauguucaccacgcacagguuuggauuucaaugaaaugauucuauugacaaugaagaauaaagcauggaugguacauagacaaugguuuuuugaccuaccccuaccauggacaucaggagcuacaacagagacaccaacuuggaacaggaaagagcuucuugugacauucaaaaaugcacaugcaaaaaagcaagaaguagucguccuuggaucgcaagagggagcaaugcacacagcgcugacaggagcuacagagauucaaaacucaggaggaacaagcauuuuugcggggcacuugaaaugcagacucaagauggacaaauuggaacucaaggggaugagcuaugcaaugugcuugaauaccuuuguguuaaagaaagaagucucugaaacgcagcaugggacaauacucauuaagguugaauacaaaggggaagaugcaccuugcaagauucccuucuccacagaggauggacaagggaaagcccacaaugguagacugaucacagccaacccaguggugaccaagaaggaggagccugucaacauugaggcugaaccuccuuuuggggaaaguaacauagugaucggaauuggagacaaagccuugaaaauuaacugguacaagaagggaagcucgaucgggaagauguucgaggccacugccagaggugcaaggcgcauggccaucuugggagacacggccugggacuuuggaucaguggguggcguucuaaauucauuagggaaaauggugcaccaaauauucggaagugcuuacacagcccuguuugguggaguuucauggauaaugaaaauuggaauagguguccuuuuaaccuggauaggguugaauucaaaaaacacuuccaugucauuuucaugcauugugauaggaauaaucacacucuaucugggaacugugguacaagcugacauggggugugucauaaacuggaaaggaaaagaacucaaauguggaaguggaaucuucgucaccaaugagguccacaccuggacagagcaauacaaauuucaagcagacuccccuaaaagacuggcgacggccauugcaggcgcuugggaaaauggaguuugcggaaucaggucgacaaccagaauggagaaucuauuguggaagcaaauagccaaugaacugaacuacauauuaugggaaaacaacaucaaauuaacgguaguugugggcgacauaauuggggucuuagagcaagggaaaagagcacuaacaccacaacccauggagcuaaaauauucauggaaaacauggggaaaggcaaaaauagugacagcugaaauacaaaauucuucuuucauaauagaugggccaaacacaccggaguguccaagugccucaagagcauggaaugugugggagguggaagauuacggguuuggaguuuucacaaccaauauauggcugaaacuccgagagguguacacccaaacaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugauuaucccaaagagucuagccggucccauuucgcaacacaaccacaggcccggguaccacacccaaacggcaggacccuggcacuugggaaaauuggagcuggacuucaacuauugugaaggaacaacaguagucaucacagaaaacugugggacaagaggcccaucacugagaacaacaacagugucagggaaguugauacacgaaugguguugccgcucgugcacacucccuccccugcgauacaugggagaggacggcugcugguauggcauggaaauuagaccuaucaaugagaaagaagagaacaugguaaagucuuuagucucagcagggaguggaaagguggacaacuucacaaugggaguccugugucuggcaauccucuucgaagaggugaugagaggaaaauuugggaaaaaacacaugauugcagggguucucuucacguuuaugcuccuucucucagggcagauaacauggagagauauggcucacacacucauaaugauuggguccaacgcuucugacaggaugggaauggguguuaccuaccuagcuuuaauagcaacauucaagauucagccauucuuggcuuugggauucuuucuaaggaaauugacauccagagaaaauuugcuguugggaguuggauuggccauggcaacaacgcuacaacugccagaggacauugaacaaauggcgaauggaauugcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuauugccagugugccagucuucgagcaugaggaaaacagauuggcucccaguggcuguggcagcuaugggaguuccacccuuaccacuuuuuaucuucaguuugaaagauacacucaaaaggaggagcuggccacugaaugagggggugauggcuguuggccuugugagcauucuagcuaguucucuccuuaggaaugacgugcccauggcuggaccacuaguggcugggggcuugcugauagcgugcuacgucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacggcauuacuaauaguaucaggcaucuuuccauacucaauacccgccacacuguuggucuggcauacuuggcaaaagcaaacccaaagaucugguguucuaugggauguacccagccccccagaaacacagaaagcagaacuggaagagggggucuauaggaucaaacaacaaggaauuuuuggaaaaacccaaguggggguuggaguacagaaagaaggagucuuccacaccauguggcacguuacaagaggggcaguguugacgcacaaugggaaaagacuagaaccaaacugggccagcgugaaaaaagaccugauuucauauggaggaggauggagauugagugcacaauggcaaaagggagaggaggugcagguuauugccguagagccugggaggaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggaguaguuacaaaaaaugguggcuacgucaguggaauagcgcaagcaaacgcagaaccagaaggaccgacaccggaauuggaagaagaaauguuuaaaaagcgaaaucuaaccauaauggaucuucauccugggucaggaaagacgcggaaauaucucccagccauugucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugagugcaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaagccuuuccucagagcaacgcuccaauucaagaugaagaaagggacauuccggaacgcucauggaauucaggcaaugaauggauuaccgacuuuguugggaagacggugugguuugucccuagcaucaaagccggaaaugacauagcaaacugcuugcggaaaaaugggaaaaaggucauucaacucaguaggaagacuuuugacacagaauaucaaaaaaccaaacugaaugauugggacuucguggugacaacagacauuucagaaaugggagccaacuuuaaagcagauagagugaucgacccaagaagaugucucaagccagugauuuugacagauggaccugagcgggugauuuuggcuggaccaaugccagucacugcagcgagugcugcgcaaaggagagggagagucggcaggaauccacaaaaagaaaaugaucaguacauauucacgggccagccucucaacaaugacgaagaccaugcucacuggacagaagcaaaaaugcugcuugacaacaucaacacaccagaagggauuauaccagcucucuuugaaccagaaagggagaagucagccgccauagacggugaauaccgccugaagggugaguccagaaagaccuucguggaacucaugaggaggggugaccuuccaguuuggcuagcccacaaaguagccucagaagggaucaaauacacagauagaaaauggugcuuugauggagaacguaauaaucaaauuuuagaggagaacauggacguggaaaucuggacaaaggaaggagaaaggaaaaaauugagaccuagguggcuugaugcccgcacuuauucagaucccuuagcacucaaagaauuuaaggauuuugcagcuggcagaaagucaaucgcucuugaucuugugacagaaauaggaagagugccuucacaccuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggccgaugucccacuucaauggaucgcgucagcuauaguccuggaauuuuucaugauggugcugcucauaccagaaccagagaagcagagaacuccccaagacaaccaacucgcauaugucgugauaggcauacucacacuggcugcgauaguagcagccaaugaaaugggacuacuggagacuacaaagagagauuuaggaaugucuaaagaaccagguguuguuucuccaaccaguuauuuagauguagauuugcacccagcaucagccuggacauuguacgcuguggccacaacaguaauaacaccaauguugagacauaccauagagaauuccacagcaaaugugucucuggcagccauagcuaaccaggcagugguccugauggguuuagacaaaggauggccaauaucgaaaauggaccuagguguaccacuacuggcacugggcugcuauucacaagugaacccacugacucucacagcggcaguacuucugcuaguuacacauuaugccauuauagguccaggauugcaggcuaaagccacucgugaggcucaaaaaaggacagcugcaggaauaaugaagaauccaacgguggaugggauaaugacaauagaccuagacccuguaauauacgauucaaaauuugaaaagcaacuaggacagguuaugcuccugguccugugugcaguucaacuuuuguuaaugagaacaucaugggccuugugugaagcucuaacccuagccacaggaccaauaacaacacuuugggaaggaucaccuggaaaguuuuggaacaccacaauagcugucuccauggcuaacaucuuuagagggagcuacuuagcaggagcuggacuugcuuuuucuaucaugaaaucaguuggaacaggaaagagaggaacggggucacaaggcgaaaccuuaggagaaaaauggaaaaagaaauuaaaucaguuaucccggagagaguuugaacuuuacaagaaaucuggaaucacugaaguggauagaacagaagccaaagaggggcugaaaagaggagaaacaacacaucaugccguguccagaggcagugcaaaacuucaaugguucguggagaggaacauggucauuccugaaggaagagucauagacuuaggcuguggaagaggaggcuggucauauuacugcgcaggacugaaaaaaguuacagaaguacgaggauacacaaaaggaggcccaggacacgaagaaccaguaccuaugucuacauauggauggaacacaguuaaguuaaugagcggaaaggauguguuuuaucuuccaccugagaagugugauacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccgacugugauugaacaccuagaaagacuacaaagaaaacauggaggaaugcuugugagaaacccacucucacgaaacuccacgcacgagauguacuggauauccaacgguaccggcaacaucgucucuucagucaauaugguauccagauugcuacugaacagauucacaaugacacacagaagacccaccauagagaaagacguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccgugggauguggugcccauggugacacagauggcaaugacagacacaacuccauuugggcagcaaagagucuuuaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccgucuucacagaggagaaccaaugggagagugcaagagcugcuguugaggacgaggaauucuggaaacuugugggcagagaacgugaacuccacaaauugggcaaguguggaagcugcguuuacaacaugaugggcaagagagagaagaaacuuggagaguuuggcaaagcaaaaggcagcagagcuauaugguacaugugguugggagccagguaccuugaguucgaagcacucggauuuuuaaaugaagaccacugguucucgcgugaaaacucuuacaguggaguagaaggagaaggacugcacaaguugggauacaucuuaagagauauuuccaagauaccuggaggagccauguaugcugaugacacagcugguugggacacaagaauaacagaagaugaccugcacaaugaggaaaaaaucacacagcaaauggacccugaacauagacaauuagcgaacgccauauuuaagcucacguaccaaaacaaaguggucaaaguucaacgaccaaccccaaaaggcacgguaauggacaucauaucuaggaaagaccaaagaggcaguggacagguggggacuuauggucugaacacauucaccaacauggaagcccaguuaaucagacagauggagggagaaggcguguugucgaaggcagaccucgagaacccucaucugcuagagaagaaaaucacacaaugguuggaaaccaaaggaguggagagauuaaaaagaauggccaucagcggggaugauuguguggugaaaccgaucgaugacagguuugcuaaugcccugcuugcccugaacgauaugggaaagguuaggaaggacauaccucaauggcagccaucaaagggcuggcaugacuggcaacaggucccuuucugcucccaucauuuucaugaacugaucaugaaagauggaagaaaguuggugguucccugcagaccccaggacgaacuaauaggaagagcgagaaucucucaaggagcaggguggagccucaaagaaacugcaugucuagggaaagccuacgcucaaauguggagucucauguauuuucauagaagagaucuuagacuagcauccaacgccauuugcucagcaguaccaguccauuggguccccacaagcagaacgacauggucuauucacgcacaccaccaguggaugaccacagaagacaugcuuacugucuggaacaggguguggauagaggacaauccauggauggaagacaaaacuccagucacaacuugggaggauguuccauaccuagggaagagagaagaucaauggugcggaucacuuaucggucucacuuccagagcaaccugggcccaaaacauacucacagcaauccaacaggugagaagccuuauaggcgaugaagaguuucuggacuacaugcccucgaugaagagauucaggaaggaggaggagucagagggagccauuugguaa

SEQ ID NO: 7745 - RNA, 9873 nt, Artificial Sequence
  derived and/or modified CDS sequence (wt) from DENV-3__JF504679__SS-prME
acaucgcucugucucaugaugauauugccagcagcacuugcuuuccacuugacuucacgagauggagagccgcgcaugaucguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccucaggcacccaggguucacuauacuagcccuauuucuugcccauuacauaggcaccuccuugacccagaaggugguuauuuuuauacuacuaaugcuggucaccccauccaugacaaugagaugugugggagugggaaacagggauuuuguggaaggucugucaggagcuacauggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagaugccccacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaguauaccgucaucauuacagugcacacaggagaccaacaccaggugggaaaugaaacgcagggagucacggcugagauaacgccucaggcaucaacuacugaagccaucuugccugaauauggaacccuugggcuagagugcucaccacggacagguuuggacuucaaugaaaugaucuuacuaacaaugaagaacaaagcauggaugguacacagacaaugguuuuuugaccuaccucuaccauggacaucaggagcuacaacagaaacaccaacuuggaacaggaaggagcuccuugugacauucaaaaaugcacaugcgaaaaaacaagaaguaguuguccuuggaucacaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucggaaacgcagcaugggacaauacucauuaaggucgaguacaaaggggaagaugcaccuugcaagauuccuuucuccacagaggauggacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaagggaagcucuauugggaagauguucgaggcuacugccagaggugcaaggcgcauggccaucuugggagacacagcuugggacuuuggaucagugggugguguucugaacucauuaggcaaaauggugcaccaaauauucggaagugcuuacacagcccuauucaguggagucuccugggugaugaaaauuggaauagguguucucuugacuuggauaggguugaauucaaaaaacacauccaugucauuuucaugcauugcgauaggaaucaucacacucuaucugggagcagugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacaguuauugcaggcgcuugggaaaauggagugugcggaauuaggucaacaaccagaauggagaaucucuuguggaagcagauagccaaugaacugaacuacauauuaugggaaaauaauauuaaauuaacgguaguugugggcgacacaauuggggucuuggagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaaaugugugaccacaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuguuucgcaacacaacuacaggcccggguaccacacccaaacggcaggacccuggcacuuaggaaaauuggagcuggacuucaacuauugugaaggaacaacaguugucaucacagaaaacugugggacgagaggcccaucauugagaacgacaacagugucaggaaaguugauacacgaaugguguugccgcucgugcacacuuccuccucugcgauacaugggagaagacggcuguugguaugguauggaaaucagacccaucagugagagagaagagaacaugguaaagucuuuagucucagcgggaaguggaaagguagacaauuucacaaugggugucuuguguuuggcaauccucuuugaagaggugaugagaggaaaauuugggaagaaacacaugauugcagggguuuucuucacguuuaugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagagaauuuacuguuaggaguuggacuggcuauggcaacaacgauacaacugccagaggacauugaacaaauggcaaauggaaucgcccuagggcucauggcucuuaaauugauaacacaauuugaaacauaccaauuauggacggcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuggccaguucucuccuuagaaaugacgugcccauggcuggaccauuaguggccgggggcuuguugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucugacagugcuuuugaagacagcauuacuaauaguaucagguaucuuuccauacuccauacccgcaacauuguuggucuggcauacuuggcaaaagcaaacccaaagauccgguguuuuaugggacguacccagccccccagagacacagaaagcagaacuggaagaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagaccacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugagauggaagaagcauugaaagggcucccaauaagguaccaaacaacagcaacaaaaucugaacacacgggaagagagauugucgaucuaaugugccacgcaacguucacgaugcgcuugcugucaccaguuaggguuccaaauuacaacuugauaauaauggaugaggcccauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaacgacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccguggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcucacaaaguagcaucagaagggaucaaauacacagauagaaaauggugcuuugauggacagcgcaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacuguuggaaacuacaaagagagaucuaggaaugucuaaggagccagguguuguuucuccaacuagcuauuuggauguggacuugcacccagcaucagccuggacauuguacgccguggccacuacaguaauaacaccaauguugagacauaccauagagaauucuacagcaaaugugucccuggcagcuauagccaaccaggcagugguccugauggguuuggacaaaggauggccaauaucaaaaauggacuuaggcguaccacuacuggcauuggguugcuauucacaagugaacccauugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaacuguuguuaaugagaacaucaugggccuugugugaagccuuaacuuuagcuacaggaccaauaacaacacucugggaaggaucaccugggaaguuuuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuugggagaaaaauggaaaaagaaacugaaucaauuaucccggaaagaguuugaccuuuacaagaagucuggaaucacugaaguggauagaacagaagccaaagaaggguugaaaagaggagaaacaacacaucaugccguguccagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacauauggauggaacauaguuaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcugaaaaacaaccaguuuugcauuaaaguauugaacccuuacaugccagccgugauugagcaccuagagagacuacaaaggaaacacggaggaaugcuugugagaaauccacuuucacgaaacuccacgcacgaaauguacuggauaucuaaugguacagguaacauugucucuucagucaacaugguauccagacuguuacugaacagguucacgaugacacacaggagaccuaccauagagaaagauguggauuuaggagcaggaacucgacauguuaaugcggaaccagaaacacccaacauggaugucauuggggaaagaauaagaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagauacaacuccauuuggccagcagagaguuuucaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggugccguuuucacagaggagaaccaaugggacagugcgaaagccgcuguugaggaugaagaauuuuggaaacuuguggacagagaacgugaacuccacaaauugggcaaguguggaaguuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacuccuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaaugaacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucuaaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaaucgaugacagguucgcuaacgcccugcuugcucugaacgauaugggaaagguucggaaagacauaccucaauggcagccaucaaagggauggcaugacuggcagcagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuaugcccaaauguggagucucauguauuuucacagaagagaucucagacuagcguccaaugccauauguucagcaguaccaguccacuggguccccacaaguagaacgacauggucuauucaugcucaccaucaguggaugacuacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauucaggaaggaggaggagucggagggagccauuugguaa

SEQ ID NO: 7746 - RNA, 9873 nt, Artificial Sequence
  derived and/or modified CDS sequence (wt) from DENV-3__KC425219__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugccuggaaccaauagagggaaaaguggugcaguaugagaaccucaaauacaccgucaucaucacagugcacacaggagaucaacaccaggugggaaaugaaacgcagggagucacggcugagauaacaccccaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuugcagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauccaaaaaacacauccaugucauuuucaugcauugcgauaggaaucauuacacucuaucugggagcuguggugcaagcugacaugggauguguuauaaacuggaaaggcaaagaacucaaauguggauccggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaucccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucucuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacauggcgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauguuuacguugacuguugccuggagaacagccacccugauuuuggccggaguuucgcuuuuaccagugugccagucuucgagcaugaggaaaacagacuggcuuccgauggcaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcuaauagcgugcuacgucauaacuggcacgucagcagaccucaccguagaaaaagcagcagauauaacaugggaggaagaggcugagcaaacaggagugucccacaacuuaaugaucacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacaccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacaaaggaaggagaaaagaaaaaacugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcauacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcauguuguggauggccgaaaucccacuccaauggaucgcgucggcuauaguccuggaguuuuuuaugaugguguugcuuauaccagaaccagaaaagcagagaaccccccaagacaaccaacucgcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguacgccguggccacuacaguaauaacaccaauguuaagacauaccauagagaauucuacagcaaaugugucucuggcagccauagccaaccaggcagugguccugauggguuuggacaaaggauggccaauaucaaaaauggacuuaggaguaccccuacuggcauuggguugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguacccauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaagauuacacaaugguuggaaaccaagggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaggccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguag

SEQ ID NO: 7747 - RNA, 9873 nt, Artificial Sequence
  derived and/or modified CDS sequence (wt) from DENV-3__AY858037__SS-prME
acaucgcucugucucaugaugauguuaccaguaacacuugcuuuccacuugacuucacgagauggagagccgcgcaugauuguggggaagaaugaaagaggaaaauccuuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccaaaccuggaugucggcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuucguggaaggucuaucaggagcuacguggguugacguggugcuugaacacggugggugugugacuaccauggcuaagaacaagcccacgcuggacauagagcuccagaagaccgaggccacccaacuggcaacccuaaggaaacuauguauugagggaaaaaucaccaacgugacaaccgacucaaggugccccacccaaggggaagcgauucuaccugaggagcaggaccagaacuacguguguaagcacacauacguggacagaggcuggggaaacgguugugguuuguuuggcaagggaagcuugguaacaugcgcgaaauuucaauguuuggaaucaauagagggaaaagugguucagcaugagaaccucaaauacaccgucaucaucacagugcacacaggagaccaacaccaggugggaaaugaaacgcagggagucacggcugaaauaacaccccaggcaucaaccgucgaagccaucuuaccugaauauggaacccuugggcuagaaugcucaccacggacagguuuggauuucaaugaaaugaucuugcugacaaugaagaacaaagcauggauggugcauagacaaugguuuuuugaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagcuacagagauccaaaccucaggaggcacaagcauuuuugcgggacacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaagagccugucaauauugaggcagaacccccuuuuggggaaaguaacauaauaauuggaauuggagacagagccuugaaaaucaauugguacaagaaggggagcucgauugggaagauguucgaggccacugccaggggugcaaggcgcauggccaucuugggagacacagccugggauuuuggaucaguaggugguguuuuaaauucacuagggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuauuugggagccguggugcaagcugacauggggugugucauaaauuggaaaggcaaagaacucaaauguggaaguggaauuuucguuacuaaugagguccacaccuggacagagcaauacaaauuucaagcagacucccccaaaagacuggcgacagccauugcaggcgccugggagaauggaguaugcggaaucaggucgacaaccagaauggagaaccucuuguggaagcaaauagccaaugaacuaaacuacauauuaugggaaaacaacaucaaauuaacgguaguugugggugacauaauuggggucuuagagcaagggaaaagaacacuaacaccacaacccauggagcuaaaauauucauggaaaacauggggaaaagcgaaaauagugacagcugaaacacaaaauuccuccuuuauaauagaugggccaaacacaccagaguguccaaaugccucaagagcauggaaugugugggagguggaagauuacggguucggagucuucacaacuaauauauggcugaaacuccgagagauguacacucaacuaugugaccacaggcuaaugucggcagccguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuggagagugacaugaucaucccaaagagucuggcugguccuaucucgcaacacaacuacaggccuggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucauguacacuuccuccccugcgauauaugggagaagauggcugcugguauggcauggaaauuagacccauuaaugagaaagaagagaacaugguaaagucuuuagucucagcagggaguggaaagguggauaacuucacaaugggugucuugugucuugcaauccucuucgaagagguaaugagaggaaaauucgggaaaaagcacaugauugcagggguucucuucacauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuagucucccuaauguguucaaacacaauuuucacguugacuguugccuggagaacagccacccugauuuuggccggaauuucgcuuuuuccagugugccagucuucgagcaugaggaaaacagauuggcucccaaugacuguggcagcuaugggaguuccaccuuuaccacuuuuuauuuucaguuugaaagacacacucaaaaggagaagcuggccacugaaugagggggugauggccguuggacuugugaguauucuagcaaguucucuccuuaggaaugacguacccauggcuggaccauuaguggcugggggcuugcugauagcgugcuacgucauaacuggcacgucagcagaccucacuguagaaaaagcagcagaugugacgugggaggaagaggcugagcaaacaggagugucccacaaucuaaugaucacaguugaugaugauggaacaaugagaauaaaagaugaugagacugagaacauuuuaacagugcuuuugaaaacagcauuacuaauagugucaggcauuuuuccauacuccauaccugcaacacuucugguuuggcacacuuggcaaaagcaaacccaaagauccggcguccugugggacguacccagccccccagagacacagaaagcagaacuggaggaaggggucuauaggaucaagcagcaaggaauuuuuggaaagacccaaguggggguuggaguacaaaaagaaggaguuuuccacacuauguggcacgucacaagaggagcaguguugacauacaauggaaaaagauuggaaccaaacugggcuagcgugaaaaaagaucugauuucauacggaggaggauggagacuaagugcacaauggcaaaaaggagaagaggugcagguuauugccguagagccugggaagaacccaaagaacuuucaaaccaugccaggcauuuuccagacaacaacaggggagauaggagcgauugcacuggacuuuaagccuggaacuucaggaucuccuaucauaaacagagagggaaagguagugggacuauauggcaauggagugguuacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagccauaguuagagaggcaaucaagagacgcuuaaggacucuaauuuuggcaccaacaagggugguugcagcugagauggaagaagcauugaaagggcucccaauaagguaucaaacaaccgcaacaaaaucugaacacacagggaaagagauuguugaucuaaugugccacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacggccacaccuccuggaacagcugaugccuuuccucagagcaacgcuccaauucaagaugaagaaagagacauaccagaacgcucauggaauucaggcaaugauuggauuaccgacuuugcuggaaagacugugugguuuguccccagcaucaaagcugggaaugacauagcaaacugcuugcggaaaaauggaaaaaaggucauucaacuuaguaggaaaacuuuugacacagaauaucaaaagacuaaacuaaaugauugggacuuuguggugacaacagacauuucagaaaugggagccaauuucaaagcagacagagugaucgauccaagaagaugucucaagccagucauuuuaacggacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcgaaaaugcugcuagacaacaucaacacaccagaaggaaucauaccagcucucuuugaaccagaaagggaaaagucagccgcuauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggaaaauauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacaucuagcccacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggcgaugcuuuucuugauaucaggcaaagggguuggaaagacuucaauaggacucauuuguguaguugcuuccagcggcauguuauggauggcugauaucccacuccaauggaucgcgucggccauaguccuggaguuuuucaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccagguguuguuucgccaaccagcuauuuggauguggauuuacacccagcaucagccuggacacuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgacucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuuccauggcgaacaucuuuagagggagcuaucuagcaggagcugggcuugcuuuuucuaucaugaagucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguugaaaagaggagaaauaacacaccaugccguauccagaggcagcgcaaaacuucaaugguucguggagagaaacauggucauuccugaaggaagagucauagacuugggcuguggaagaggaggcuggucauauuacugugcaggauugaaaaaaguuacggaagugcgaggauacacaaaaggcggcccaggacaugaagaaccaguaccuaugucuacauauggauggaacauagucaagcugaugaguggaaaggauguguuuuaucucccaccugaaaagugugacacucuauugugugacauuggagaaucuucaccaagcccaacaguggaagagagcagaaccauaagagucuugaaaaugguugaaccauggcuaaaaaauaaccaguuuugcaucaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaauaugguauccagacugcuacugaacagauucacaaugacauauaggagacccaccauagagaaagauguggauuuaggagcggggacccgacaugucaaugcggaaccagaaacacccaacauggaugucauuggggaaagaauaagaagaaucaaggaggagcauaguucaacauggcacuaugaugaugaaaauccuuacaaaacgugggcuuaccauggaucuuaugaaguuaaggccacaggcucagccuccuccaugauaaauggagucgugaaacuccuuacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacggaggagaaccaaugggacagcgcuagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauauaucuugagagauauuuccaagauaccuggaggagccauguaugcugaugacacagcugggugggauacaagaauaacagaagaugaccugcacaaugaggaaaaaaucacacagcaaauggacccugaacacaggcaguuagcaaacgcuauauuuaagcucacauaccaaaacaaaguggucaaagugcaacgaccaacuccaaagggcacgguaauggacaucauaucuaggaaagaccaaagaggcaguggacaggugggaacuuaugguuugaauacauucaccaacauggaagcccaguugaucagacaaauggaaggagaagguguguugucgaagacagaccucgagaacccucaucugcuagagaagaaaaucacacaaugguuggaaacuaaaggaguggagagguuaaaaagaauggccaucagcggggaugauugcguggugaaaccaauugacgacagguucgccaaugcccugcuugcccuaaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauugauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaggaccaauggugcggaucacucauuggucucacuuccagagcaaccugggcucagaacauacuuaccgcaauccaacagguaagaagccuuauaggcaaugaagaguuucuggacuacaugccuucuaugaagagauucaggaaggaggaggagucagagggagccauuugguaa

SEQ ID NO: 7748 - RNA, 9873 nt, Artificial Sequence
  derived and/or modified CDS sequence (wt) from DENV-3__KJ737429__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuauggaacgugcaaucaagcuggggagcacagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacaccccaggcaucaaccguugaagcugucuugccugaguauggaacccuugggcuagaaugcucaccacggacaggcuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcgaaaaagcaagaaguaguuguccuuggaucacaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauagggcugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaaaucuuuagucucagcagggaguggaaaaguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggauguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguaguaggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugaaauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacuuaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuacuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacauugucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguccaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7749 - RNA, 9873 nt, Artificial Sequence
  derived and/or modified CDS sequence (wt) from DENV-3__DQ863638__SS-prME
acaucgcucugucucaugaugauguuaccagcaacacuugcuuuccacuuaacuucacgagauggagagccgcgcaugauuguggggaagaaugaaagaggaaaaucccuacuuuuuaagacagcuucuggaaucaacaugugcacacucauagccauggacuugggagagaugugugaugacacggucacuuacaaaugcccccacauugccgaaguggaaccugaagacauugacugcuggugcaaccuuacaucgacaugggugacuuauggaacgugcaaucaagcuggggagcacagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcucuauuucuugcccauuacauaggcacuuccuugacccagaaagugguuauuuuuauacuacuaauacuggucacuccauccauggcaaugagaugcgugggaguaggaaacagagauuuuguggaaggucuaucgggagcuacguggguugacguggugcucgagcacggugggugugugaccaccauggcuaagaacaagcccacgcuggacauagagcuucagaagaccgaggccacccaacuggccacccuaaggaaguuaugcauugagggaaaaauuaccaacauaacaacugacucaagguguccuacccagggggaagcgauuuuaccugaggagcaggaccagaacuacguauguaagcauacauacguggauagaggcuggggaaacgguugugguuuguuuggaaaaggaagcuuggugacaugcgcgaaauuucaaugcuuagaaucaauagagggaaaaguggugcaacaugagaaccucaaauacacugucaucauuacagugcacacaggagaccaacaccaggugggaaaugaaacgcagggagucacggcugagauaacaccccaggcaucaaccguugaagcuaucuugccugaauauggaacccuugggcuagaaugcucaccacggacagguuuggauuucaaugaaaugaucuuauugacaaugaagaacaaagcauggaugguacauagacaaugguucuuugaccucccccuaccauggacaucaggagcuacaacagagacaccaacuuggaacaggaaagagcuucuugugacauucaaaaaugcacaugcaaaaaagcaagaaguaguuguccuuggaucgcaagagggagcaaugcacacagcgcugacaggagcuacagagauccaaaacucaggaggcacaagcauuuuugccgggcacuugaaauguagacuuaagauggacaaauuggaacucaaggggaugagcuaugcaaugugcuugaacaccuuuguguugaagaaagaagucuccgagacgcagcaugggacaauacucauuaagguugaguacaaaggggaagaugcaccuugcaagauuccuuucuccacggaggauggacaagggaaagcucacaaugguagacugaucacagccaacccaguggugaccaagaaggaggagccugucaacauugaggcugaaccuccuuuuggggaaaguaacauagugauuggaauuggagacaaagccuugaaaauuaacugguacaagaagggaagcucgauugggaagauguucgaggccacugccagaggugcaaggcgcauggccaucuugggagacacagccugggacuuuggaucaguggguggugucuugaauucauuagggaaaaugguccaccaaauauuuggaagugcuuacacagcccuguuuaguggagucucauggauaaugaaaauuggaauagguguccucuuaaccuggauaggguugaauucaaaaaacacuuccaugucauuuucauguauugcgauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacucccccaaaagacuggcgacagccauugcaggcgccugggaaaauggagucuguggaaucaggucaacaaccagaauggagaaucuauuguggaagcaaauagccaaugaacugaacuacauauuaugggaaaacaacaucaaauuaacgguaguggugggcgacauaauuggggucuuagagcaagggaaaagaacacuaacaccacaacccauggagcuaaaauauucauggaaaacauggggaaaagcaaaaauagugacagcugaaacacaaaauuccucuuucauaauagaugggccacacacaccggaguguccacgugccucaagagcauggaaugugugggagguggaagauuacggguuuggagucuucacaaccaacauauggcugaaacuccgagaggaguacacccaauugugcgaccauaggcuaaugucagcagccgucaaagaugagagggccgugcaugccgacaugggcuauuggauagaaagccaaaagaauggaaguuggaagcuagaaaaagcaucccucauagagguaaaaaccugcacuuggccaaaaucacacacucuuuggaguaaugguguacuagagagugacaugaucaucccaaagagucuagcugguccuauuucgcaacacaaccacaggcccggguaccacacccaaacggcaggacccuggcacuugggaaaauuggagcuggacuucaacuauugugaaggaacaacaguugucaucacagaaaacugugggacaagaggcccaucauugagaacaacaacagugucggggaaguugauacacgaaugguguugccgcucgugcacacuuccucccuugcgauacaugggagaagacggcugcugguauggcauggaaauuagacccaucaaugagaaagaagagaacaugguaaagucuuuagccucagcagggaguggaaagguggacaacuucacaauggguuuccuguguuuggcaauccucuucgaagaggugaugagaggaaaauuugggaaaaaacacaugauugcagggguuuuccucacguuuuugcuccuucucucagggcaaauaacauggagagauauggcgcacacacucauaaugauuggguccaacgcuucugacaggaugggaaugggcguuaccuaccuagcuuuaauugcaacauuuaaaauccagccauucuuggcuuugggauucuuccugaggaaauugacaucuagagaaaauuuccuguugggaguuggguuggccauggcaacaacguuacaacugccagaggacauugaacaaauggcgaauggaauugcucuggggcucauggcucuuaaacugauaacacaauuugagacauaccaguuauggacggcauuagucucccuaacguguucaaauacaauuuucacguugacuguugccuggagaacagccaccuugauucuggccggaguuucgcuuuugccagugugccagucuucgagcaugaggaaaacagauuggcucccaauggcuguggcagcuaugggaguuccacccuuaccacuuuucaucuucagcuugaaagauacacucaaaaggagaagcuggccacugaaugagggggugauggcuguugggcuugugagcauucuagcuagcucucuccuuaggaaugaugugcccauggcuggaccauuaguggccgggggcuugcugauagcgugcuacgucauaacuggcacgucagcggaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacagcauuacuaauaguaucaggcaucuuuccauauuccauacccgccacacuguuggucuggcauacuuggcaaaagcaaacccaaagaucuggcguucuaugggacguacccagccccccagaaacacagaaagcagaacuggaagagggggucuauaggaucaaacagcaaggaauuuuugggaaaacccaaguggggguuggaguacagaaagaaggagucuuccauaccauguggcacgucacaagaggggcaguguugacgcacaaugggaaaagauuggaaccaaacugggccagcgugaaaaaagaucugauuucauacggaggaggauggagauugagugcacaauggcaaaagggagaggaggugcagguuauugccguagagcccgggaagaacccaaagaacuuucaaaccaugccgggcauuuuucagacaacaacaggggaaauaggagcaauugcacuagacuucaagccuggaacuucaggaucuccuaucauaaacagagagggaaagguagugggacuguauggcaauggagugguuacaaagaaugguggcuacgucaguggaauagcgcaaacaaaugcagaaccagacggaccgacaccggaguuggaagaggagauguucaaaaagcgaaaucuaaccauaauggaucuucauccugggucaggaaagacgcggaaauaucuuccagcuaucgucagagaagcaaucaagagacgcuuaagaacucuaauuuuggcaccaacaagggugguugcagcugagauggaagaagcauugaaagggcucccaauaagguaucaaacaacugcaacaaaaucugaacacacaggaagggagauuguugaucuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaaucuucaugacagcaacacccccuggaacagccgaugccuuuccucagagcaacgcuccaauucaagaugaagaaagggauaucccggaacgcucauggaauucaggcaaugaauggauuaccgacuuuguugggaagacagugugguuuguccccagcaucaaagccggaaaugacauagcaaacugcuugcggaaaaauggaaaaaaggucauucaacuuaguaggaagacuuuugauacagaauaucaaaagaccaaacugaaugauugggacuucguggugacaacagacauuucagaaaugggagccaacuuuaaagcagauagagugaucgacccaagaagaugucucaagccagugauuuugacagauggacccgagcgggugauccuggcuggaccaaugccagucacugcagcgagcgcugcgcaaaggagagggagaguuggcaggaacccacaaaaagaaaaugaccaguacauauucaggggccaaccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggugaguccaggaagaccuucguggaacucaugaggaggggugaccucccaguuuggcuagcccauaaaguagcaucagaagggaucaaauauacagauagaaaauggugcuuugauggagaacguaauaaucaaauuuuagaggagaacauggauguggaaaucuggacaaaggaaggagaaaagaaaaaauugagaccuagguggcuugaugcccgcacuuauucagaucccuuggcacucaaggaauucaaggauuuugcagcuggcagaaagucaaucgcccuugaucuugugacagaaauaggaagagugccuucacauuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuguucuugauaucagguaaagggauuggaaagacuucaauaggacucaucuguguaauugcuuccaguggcauguuauggauggccgaugucccacuucaauggaucgcgucggcuauaguccuggaauuuuucaugaugguguugcuuauaccagaaccagaaaagcagagaacuccccaagacaaccaacucgcauaugucgugauaggcauacuuacacuggcugcaauaguagcagccaaugaaaugggacuguuggaaacuacaaagagagauuuaggaaugucuaaagaaccagguguuguuucuccaaccagcuauuuagauguagacuugcacccagcaucagccuggacauuguacgcuguggccacaacaguaauaacaccaauguugagacauaccauagagaauuccacagcaaaugugucccuggcagcuauagcuaaccaggcagugguccugaugggcuuagacaaaggauggccaauaucgaaaauggacuuaggcguaccacuacuggcacugggcugcuauucacaagugaacccacugacucucacagcggcaguacuuuugcuagcuacacauuaugcuauuauagguccaggauugcaggcaaaagccacucgugaagcucaaaaaaggacagcugcuggaauaacgaagaacccaacgguggaugggauaaugacaauagaccuagauccuguaauauacgauucaaaauucgaaaagcaacuaggacagguuaugcuccuaguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuauuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaauaacacgucaugccguguccagaggcagcgcaaaacuucaaugguucguggagaggaacauggucauucccgaaggaagagucauagacuuaggcuguggaagaggaggcuggucauauuacugcgcaggauugaaaaaaguuacagaagugcgaggauacacaaaaggcggcccaggacacgaagaaccaguaccuaugucuacauacggauggaacauagucaaguuaaugaguggaaaggauguguuuuaucucccaccugaaaagugugacacccuauugugugacauuggagaaucuucaccaagcccaacaguggaagaaagcagaacuauaagaguuuugaagaugguugaaccauggcuaaaaaauaaccaguuuugcauuaaaguauuaaacccuuacaugccaacugugauugagcaccuagaaagacuacaaaggaaacauggaggaaugcuugugagaaauccacucucacgaaacuccacgcacgaaauguacuggauauccaaugguaccggcaacaucgucucuucagucaacaugguauccagauugcuacugaacagauuuacaaugacacacaggagacccaccauagagaaagauguggauuugggagcaggaacccgacaugucaaugcggaaccagaaacacccaauauggacgucauuggagaaagaauaaaaaggaucaaggaggagcauaauucaacauggcacuaugaugaugaaaauccuuacaaaacgugggcuuaccauggauccuaugaagucaaagccacaggcucagccuccuccaugauaaauggagucgugaaacuccucacaaaaccaugggauguggugcccauggugauacagauggcaaugacagauacaacuccauuugggcagcaaagaguuuucaaagagaaaguggacaccaggacacccaggcccaugccagggacaagaaagguuauggagaucacagcggaauggcuuuggagaacccugggaaggaacaaaagacccagauugugcacaagggaagaguucacaaagaaggucagaaccaacgcggcuaugggcgccguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagccagguaccuugaguucgaggcacucggauucuucaaugaagaccacugguucucgcgugaaaacucuuacaguggaguagaaggagaaggacugcacaagcugggauacauuuuaagagauauuuccaagauacccggaggagcuauguaugcugaugacacagcugguugggacacaagaauaacagaagaugaccugcacaaugaggaaaaaaucacacagcaaauggacccugaacacagacaguuagcgaacgccauauucaagcucacauaccaaaacaaaguggucaaaguucaacgaccaacuccaaaaggcacgguaauggacaucauaucuaggaaagaccaaagaggcaguggacagguggggacuuauggucugaauacauucaccaacauggaagcccaguuagucagacagauggaaggagaaggcguguugucgaaggcagaccuugagaauccucaucugcuagagaagaaaaucacacaaugguuggaaaccaaaggaguggagagguuaaaaagaauggccaucaguggggaugauugcguagugaaaccgaucgacgacagguuugccaaugcccugcuugcccugaacgauaugggaaagguuaggaaggacauaccucaauggcagccaucaaaggguuggcaugauuggcaacaggucccuuucugcucccaccacuuucaugaacugaucaugaaagauggaagaaaguuggugguucccugcagaccccaggacgaacuaauaggaagagcgagaaucucucgaggagcaggauggagccuuaaagaaacugcaugucuagggaaagccuacgcucaaauguggagccucauguauuuucacagaagagaucuuagacuagcauccaacgccauauguucagcaguaccaguccauugggucccuacaagcagaacgacauggucuauucaugcucaccaucaguggaugacuacagaagacaugcuuacugucuggaacaggguguggauagaggacaauccauggauggaagacaaaacuccagucacaacuugggaagauguuccauaccuagggaagagagaagaccaauggugcggaucacucaucggucucacuuccagagcaaccugggcccagaacauacucacagcaauccaacaagugagaagccuuauaggcaaugaagaguuucuggacuacaugccuucgaugaagagauucaagaaggaggaggagucagagggagccauuugguaa

SEQ ID NO: 7750 - RNA, 9873 nt, Artificial Sequence
  derived and/or modified CDS sequence (wt) from DENV-3__KJ737430__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugacuuauggaacgugcaaucaagcuggggagcauagacgcgacaagagaucaguggcguuagcuccccaugucggcaugggacuggacacacgcacccaaaccuggaugucggcugaaggagcuuggagacaagucgagaagguagagacaugggcucuuaggcacccaggguucaccauacuagcucuauuucuugcccauuacauaggcacuucccugacccagaaagugguuauuuuuauacuacuaaugcuggucacuccauccauggcaaugagaugcgugggaguaggaaacagagauuuuguggaaggucugucgggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaauuaccaacauaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaucaauagagggaaaaguggugcaacaugagaaccucaaauacaccgucaucaucacagugcacacaggagaccaacaccaggugggaaaugacacgcagggagucacgguugagauaacaccccaggcaucaaccguugaagcuaucuugccugaauauggaacccuugggcuagaaugcucaccacggacagguuuggauuucaaugaaaugauuuuauugacaaugaagaacaaagcauggaugguacauaggcaaugguucuuugaccuaccccuaccauggacaucaggagcuacaacagagacaccaacuuggaacaggaaagagcuucuugugacauucaaaaaugcacaugcaaaaaagcaagaaguaguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcucacaaugguagacugaucacagccaacccaguggugaccaagaaggaggagccugucaacauugaggcugaaccuccuuuuggggaaaguaacauagugauuggaauuggagacaaagccuugaaaauuaacugguacaagaagggaagcucgauugggaagauguucgaggccacugccagaggugcaaggcgcauggccaucuugggagacacagccugggacuuuggaucagugggugguguucuaaauucauuagggaaaauggugcaccaaauauucggaagugcuuacacagcccuguuuaguggagucucauggauaaugaaaauuggaauagguguccucuuaaccuggauaggguugaauucaaaaaacacuuccaugucauuuucaugcauugcgauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagaaguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucgcaacacaaccacaggcccggguaccacacccaaacggcaggacccuggcacuugggaaaauuggagcuggacuucaacuauugugaaggaacaacaguagucaucacagaaaacugugggacaagaggcccaucauugagaacaacaacagugucagggaaguugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauucagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucauggcucuaaaacugauaacacaauuugagacauaccaguuauggacggcauuagucucccuaacguguucaaacacaauuuucacguugacuguugccuggagaacagccaccuugauucuggccggaguuucgcuuuugccagugugccagucuucgagcaugaggaaaacagauuggcucccaauggcuguggcagcuaugggaguuccacccuuaccacuuuuuaucuucagcuugaaagauacacucaaaaggaggagcuggccacugaaugagggggugauggcuguugggcuugugagcauucuagcuaguucucuccuuaggaaugaugugcccauggcuggaccacuaguggccgggggcuugcugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaagaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggaguacagaaagaaggagucuuccacaccauguggcacgucacaagaggggcaguguugacgcacaaugggaaaagacuggaaccaaacugggccagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacuuuaauuuuggcaccaacaagagugguugcagcugagauggaagaagcauugaaaggacucccaauaagguaucaaacaacugcaacaaaaucugaacacacaggaagggagauuguugaucuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacagccgaagccuuuccucagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugcuugcgaaaaaauggaaaaaaggucauucaacuuaguaggaagacuuuugauacagaauaucaaaagaccaaacugaaugauugggacuucguggugacaacagacauuucagaaaugggagccaacuuuaaagcagauagagugaucgacccaagaagaugucucaagccagugauuuugacagauggacccgagcgggugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggauuauaccagcucucuuugaaccagaaagggagaagucagccgcuauagacggugaauaccgccugaagggugaguccaggaagaccuucguggaacucaugaggaggggugaccucccaguuuggcuagcccauaaaguagcaucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuguuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaagcagagaacuccccaagacaaucaacucgcauaugucgugauaggcauacuuacacuggcugcgauaguagcagccaaugaaaugggacuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccacuacuggcacugggcugcuauucacaagugaacccacugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacagguuaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaaguuaaugaguggaaaggauguguuuuaucuuccaccugaaaagugugacacccuauugugugacauuggagaaucuucaccaagcccaacaguggaagaaagcagaacuauaagaguuuugaagaugguugaaccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcacgaaauguacuggauauccaaugguaccggcaacaucgucucuucagucaacaugguauccagauugcuacugaacagauuuacaaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggauguggugcccauggugauacagauggcaaugacagauacaacuccauuugggcagcaaagaguuuucaaagagaaaguggacaccaggacacccaggcccaugccagggacaagaaagguuauggagaucacagcggaauggcuuuggagaacccugggaaggaacaaaagacccagauugugcacaagggaagaguucacaaaaaaggucagaaccaacgcggcuaugggagccguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagauauuuccaagauaccuggaggagcuauguaugcugaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgauaugggaaagguuaggaaggacauaccucaauggcagccaucaaaggguuggcaugauuggcaacaggucccuuucugcucccaccacuuucaugaacugaucaugaaagauggaagaaaguuggugguucccugcagaccccaggacgaacuaauaggaagagcgagaaucucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagagcaaccugggcccagaacauacucacagcaauccaacaggugagaagccuuauaggcgaugaagaguuucuggacuacaugccuucgaugaagagauucaggaaggaggaggagucagagggagccauuugguaa

SEQ ID NO: 7751 - RNA, 9873 nt, Artificial Sequence
  derived and/or modified CDS sequence (wt) from DENV-3__AY858040__SS-prME
acaucgcucugucucaugaugauguuaccggcaacacuugcuuuccacuugacuucacgagauggagagccgcgcaugauuguggggaagaaugaaagaggaaaaucccuacucuuuaagacagccucuggaauuaacaugugcacacucauagccauggauuugggagaaaugugugaugacacggucacuuacaaaugcccccucauuacugaaguggagccugaagacauugacugcuggugcaaccucacaucgacaugggugaccuacggaacgugcaaccaagcuggggagcauagacgcgacaagaggucgguggcguuagcuccucaugucggcaugggacuggacacacgcgcccaaaccuggaugucggcugaaggagcuuggagacaagucgagaagguagagacaugggccuuuaggcacccaggguuuacaauacuagcccuauuucuugcccauuacauaggcaccuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuaccauggccaagaacaagcccacgcuggacauagagcuccagaagaccgaggccacccaacuggcaaccuuaaggaaacuaugcauugagggaaaaaucaccaacgugacaaccgacucaaggugccccacccaaggggaagcgauucuaccugaggagcaggaccagaacuacguguguaagcacacauacguggacagaggcuggggaaacgguugugguuuguuuggcaagggaagcuugguaacaugcgcgaaauuucaauguuuggaauuaauagagggaaaaguggugcaacaugagaaccucaaauacaccgucaucaucacagugcacacaggagaccaacaccaggugggaaacgaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaaaaacaaagcauggaugguacauagacaaugguuuuuugaccuaccucuaccauggacaucaggggcuacaacagaaacaccuaccuggaauaagaaagagcuucuugugacauucaaaaaugcacacgcaaaaaaacaagaaguaguaguccuuggaucgcaagagggagcaaugcacacagcacugacaggagcuacagagauccaaaccucaggaggcacaaguauuuuugcggggcacuugaaaugcagacucaagauggauaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaacuggaaaggcaaagaacucaaauguggaaguggaauuuucguuacuaaugagguccacaccuggacagagcaauacaaauuucaagcagacucccccaaaagacuggcgacagccauugcaggcgccugggagaauggagugugcggaaucaggucgacaaccagaauggagaaccucuuguggaaacaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaaaacaaaauuccuccuuuauaauagaugggccaaacacaccagaguguccaaaugccucaagagcauggaaugugugggagguggaagauuacggguucggagucuucacaacuaauauauggcugaaacuccgagagauguacacccaacuaugugaccacagguuaaugucggcagccguuaaggaugagagagcuguacacgccgacaugggcuauuggauagaaagccaaaagaaugguaguuggaagcuagaaaaggcaucucucauagaggugaaaaccugcacauggccaaaaucacacacucucuggagcaaugguguguuggagagugacaugaucaucccaaagagucuggcugguccuaucucgcaacacaacuacaggcccggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaaucagacccauuaaugagaaagaagagaacaugguaaagucuuuagucucagcagggaguggaaagguggacaacuucacaaugggugucuugugucuugcaauccucuuugaagagguaaugagaggaaaauucgggaaaaagcacaugauugcagggguucucuucacauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuucuugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuagucucccuaauguguucaaacacaauuuucacguugacuguugccuggagaacagccacccugauuuuggccggaauuucgcuuaugccagugugccagucuucgagcaugaggaaaacagauuggcucccaaugacuguggcagcuaugggaguuccaccucuaccacuuuuuauuuucaguuugaaagacacacucaaaaggagaagcuggccacugaaugagggggugauggccguuggacuugugagcauucuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauaguaucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccacacuauguggcacgucacaagaggagcaguguugacauacaaugggaaaagacuggaaccaaacugggcuagcgugaaaaaagaucugauuucauacggaggaggauggagacugagugcauacuggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguagcagcugagauggaagaagcauugaaagggcucccaguaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacaccuccuggaacagcugaugccuuuccucagagcaacgcuccaauucaagaugaagaaagagacauaccagaacgcucauggaauucaggcaaugauuggaucaccgacuuugcaggaaagacugugugguuuguccccagcaucaaagcugggaaugauauagcaaacugcuugcgaaaaaauggaaaaaaggucauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucacaguagcgagugcugcgcaaaggagagggagaguuggcaggaacccacaaaaagaaaaugaccaauacauauucacgggccagccccuuaacaaugacgaagaccacgcucacuggacagaagcaaaaaugcugcuagacaacaucaacacaccagaaggaaucauaccagcucucuuugaaccagaaagggagaagucagccgccauagacggcgaauaccgcccgaaaggugaguccaggaagaccuucguggaacucaugaggaggggugaccucccaguuuggcuagcccauaaaguagcaucagaaggaaucaaauacacagacagaaaauggugcuuugauggagagcgcaacaaucaaauuuuagaggagaauauggauguggaaaucuggacaaaggaaggagaaaagaaaaaauugaggccuagguggcuugaugcccgcacuuauucagaucccuuagcgcucaaggaauucaaggacuuugcggcugguagaaagucgauugcccuugaucuugugacagaaauaggaagagugccuucacauuuagcucacagaacgagaaacgcucuggacaauuuggugauguugcacacgucagaacacggugggagggccuacaggcaugcaguggaggaauuaccagaaacaauggaaacacucuuacuccugggacucaugauccuguuaacggguggggcgaugcuuuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuagggauguccaaagaaccagguguuguuucgccaaccagcuauuuggauguggauuugcacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcauuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguugaaaagaggagaaauaacacaccaugccguauccaggggcagcgcaaaacuucaaugguucguggagagaaacauggucauuccugaaggaagaguuauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagagagcagaaccauaagggucuugaaaaugguugaaccauggcuaaaaaauaaccaguuuugcauuaaaguauugaacccuuacaugccaacugugauugagcaccuugaaagacuacaaaggaaacauggaggaaugcuugugagaaauccacucucacgaaacuccacgcacgaaauguacuggauaucuaacggcacagguaacaucgucucuucagucaacaugguauccagacugcuacugaacagauucacaaugacauauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcggaauggcuuuggagaaccuugggaaggaacaaaagacccagauuaugcacgagagaggaguucacaaaaaaggucagaaccaacgcagcuaugggcgccguauuuacagaggagaaccaaugggacagugccagagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccacugguucucgcgugaaaacucuuacaguggaguagaaggggaaggauugcauaagcugggauacaucuugagagauauuuccaagauacccggaggagccauguaugcugaugacacagcugggugggacacaagaauaacagaagaugaccugcacaaugaggaaaaaaucacacagcaaauggaaccugaacacaggcaguuagcaaacgcuauuuuuaagcucacauaccaaaacaaaguggucaaaguucaacgaccaacuccaaagggcacgguaauggacauuauaucuaggaaagaccaaagaggcaguggacaggugggaacuuauggucugaauacauucaccaacauggaagcccaauugaucagacaaauggaaggagaagauguguugucgaagacagaccucgagaacccucaucugcuggagaagaaaauuacacaaugguuggaaaccaaaggaguggagagguuaaaaagaauggccaucagcggggaugauugcguggugaaaccaaucgacgacagguucgccaaugcccugcuugcccugaaugacaugggaaaaguuaggaaggacauaccccaauggcagccaucgaaaggauggcaugauuggcaacaagucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugucuagggaaagccuacgcccaaaugugggcccucauguauuuucacagaagagaucuuagacuagcauccaaugccauauguucagcaguaccaguccauuggguccccacaagcagaacgacgugguccauccaugcucaccaucaguggaugacuacagaagacaugcuuaccguuuggaacaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaagagucagagggagccauuugguaa

SEQ ID NO: 7752 - RNA, 9873 nt, Artificial Sequence
  derived and/or modified CDS sequence (wt) from DENV-3__AY858041__SS-prME
acaucgcucugucucaugaugauguuaccagcaacacuugcuuuccacuugacuucacgagauggagagccgcgcaugauuguggggaagaaugaaagaggaaaaucccuacuuuucaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucauguuggcaugggacuggacacacgcgcccaaaccuggaugucggcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuacuauggcuaagaacaagcccacgcuggacauagagcuccagaagaccgaggccacccaacuggcaacccuaaggaaacuaugcauugaggggaaaaucaccaacgugacaaccgacucaaggugccccacccaaggggaagcgauucuaccugaggagcaggaccagaacuacguguguaagcacacauacguggacagaggcuggggaaacgguugugguuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacagugguuuuucgaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagccacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggcaagcccacaauggcagacugaucacagcuaacccaguggugaccaagaaggaagagccugucaauauugaggcagaaucuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccucuuaacuuggauaggguuaaauucaaaaaacacuucuaugucauuuucaugcauugugauaggaauuaucacacucuaucugggagccguggugcaagcugauauggggugugucauaaacuggaaaggcaaagaacucaaauguggaaguggaauuuucgucacuaaugagguccacaccuggacagagcaauacaaauuucaagcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaaacuccgagagauguacacccaacuaugugaccacaggcuaaugucggcagcuguuaaagaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuagagagugacaugaucaucccaaagagucuggcugguccuaucucgcaacacaacuacaggcccggauaccacacccaaacagcaggacccuggcaccuaggaaaauuggagcuggacuucaacuauugugaaggaacaacaguugucaucacagaaaauugugggacaagaggcccaucacugaggacaacaacagugucaggaaaauugauacacgaaugguguugccgcucguguacacuuccuccccugcgauauaugggagaugacggcugcugguauggcauggaaauuagacccauuaaugagaaagaagagaacaugguaaagucuuuagucucagcagggaguggaaagguggauaacuucacaaugggugucuugugucuugcaauccucuuugaagagguaaugagaggaaaauuugggaaaaagcauaugauugcagggguucucuucauguuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacauccagagaaaauuuauuauugggaguuggguuggccauggcaacaacguugcaacugccagaggacauugaacaaauggcgaauggaauagcccuggggcucauggcucuuaaauugauaacacaauuugaaacauaccaacuauggacggcauuagucucccuaacguguucaaauacaauuuucacguugacuguugccuggagaacagccaccuugaucuuggccggaauuucgcuuuugccagugugccaguccucgagcaugaggaaaacagauuggcucccaaugacuguggcagcuaugggaguuccaccucuaccacuuuuuaucuucaguuugaaagauacacucaaaaggagaagcuggccacugaaugagggggugauggccguuggacuugugagcauucuagcaaguucucuccuuaggaaugacguacccauggcuggaccauuaguggcugggggcuugcugauagcgugcuacguuauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacaguacuuuugaaaacagcacuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccacacuauguggcacgucacaagaggggcaguguugacauacaauggaaaaagacuggaaccaaacugggcuagugugaaaaaagaucugauuucauacggaggaggauggagacugagugcacaauggaaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagauggaccgacaccagaguuggaagaagagauguucaaaaagcgaaaucuaaccauaauggaucuccaucccgggucaggaaagacgcggaaauaccuuccagcuauaguuagagaggcaaucaaaagacgcuuaaggacucuaauuuuggcaccaacuagggugguugcagcugagauggaagaagcauugaaagggcucccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacacccccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagacauuucagaaaugggagccaacuucaaagcagacagagugaucgacccaagaagaugucucaagccaguuauuuugacagacggacccgagcgcgugauccuggcgggaccaaugccagucaccguagcgagugcugcgcagaggagagggagaguuggcaggaacccacaaaaagaaaaugaccaauacauauucacgggccagccccucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacuuaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuggcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagaacacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccagguguugucucgucaaccagcuauuuggauguggauuugcacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccucugcuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguugaaaagaggagaaauaacacaccacgccguauccagaggcagcgcaaaacuucaaugguucguggagagaaacauggucauuccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagaaagcagaaccauaagagucuugaaaaugguugaaccauggcuaaaaaauaaccaguuuugcauuaaaguauugaacccuuauaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggucagcaaaggguuuuuaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacaaggcaaguguggaagcugcguuuacaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaacgaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaaggauggccaucagcggggaugauugcguggugaaaccaauugacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauuaauagggagagcgagaaucucccagggagcaggauggagccuuaaagaaacugcaugccuagggaaagccuacgcccaaaugugggcucucauguauuuucacagaagagaucuuagacuagcauccaacgccauaugcucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaaugguguggaucacucauuggucucacuuccagagcaaccugggcucagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7753 - RNA, 9873 nt, Artificial Sequence
  derived and/or modified CDS sequence (wt) from DENV-3__KC261634__SS-prME
acaucgaucugucuuaugaugauguuaccagcaacacuugcuuuccaccugacuucacgcgauggagagccgcgcaugauuguggggaagaaugaaagggggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacaugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccaggcuucaccauauuagcucuauuccuugcccauuacauaggcacuucccugacccagaaagugguuaucuuuauucuacuaaugcuggucaccccauccaugacaaugagaugugugggaguaggaaacagagacuuuguggaagguuugucaggagcuacguggguugauguggugcucgagcacggugggugugugaccaccauggcuaagaacaggccuacgcuggacauagagcuucagaagaccgaggccacccaacuggcgacccuaaggaaguuaugcauugagggaaagauuaccaacauaacaaccgacucaaggugucccacccagggggaagcgguucuaccugaggagcaggaccagaacuacguaugcaagcacacauacguggauagagguuggggaaacgguuguggcuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacgccccaggcaucuaccguugaagcugucuugccugaguauggaacccuugggcuagaaugcucaccacggacaggcuuggauuuuaaugaaaugauuuuguugacaaugaagaacaaagccuggaugguacauaggcaaugguucuuugaccuacccuuaccauggacaucaggagccacaacagagacaccaaccuggaacaggaaggaacuucuuguaacauucaaaaaugcacaugcaaaaaagcaagaaguaguuguccuuggaucgcaagagggagcaaugcacacggcgcugacaggagcuacagagauucaaaauucaggagguacgagcauuuuugcggggcacuugaaauguagacucaagauggacaaauuggaacucaaggggaugagcuaugcaaugugcuugaauaccuuuguguugaagaaagaagucucugaaacgcagcaugggacaauacucauuaggguugaguacaaaggggaagaugcaccuugcaagauuccuuucuccacagaggauggacaagggaaagcccacaaugguagacugaucacagccaacccaguggugaccaagaaggaggagccugucaacauagaggcugaaccuccuuuuggggaaagcaacauagugauuggaacuggagauaaagccuugaaaauaaacugguacaagaagggaagcucgauugggaagauguucgaggccacugccagaggugcaaggcgcauggccaucuugggagacacagccugggacuuugguucagugggugguguucuaaauucauuagggaaaauggcgcaccaaauauucggaagugcuuacacagccuuguuuagcggagucucauggauaaugaaaauuggaauagguguccucuuaaccuggauaggguugaauucaaaaaacacuuccaugucauuuucauguauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaagagacuggcgacagccaucgcaggcgcuugggaaaauggagucuguggaaucaggucaacaaccagaauggagaaucuauuguggaagcaaauagccaaugagcugaauuacauauuaugggaaaacaacaucaaauuaacggugguggugggcgacauaauuggggucuuagaacaagggaaaagaacacuaacaccacagcccauggagcuaaaauauucauggaaaacauggggaaaggcaaaaauagugacagcugaaauacaaaauuccucuuucauaauagaugggccaaacacaccggaguguccaagugccucaagagcauggaaugugugggagguggaagacuacgguuuuggagucuucacaaccaacauauggcugaaacuccgagaaguguacacccaaucaugugaccauaggcuaaugucggcagccaucaaagacgagagggccgugcaugccgacaugggcuauuggauagaaagccaaaagaauggaaguuggaagcuagaaaaagcauccuucauagagguaaaaaccuguacuuggccaaaaucacacacucuuuggagcaauggugugcuagagagugacaugaucaucccaaagagucuagcugguccuauuucacaacacaaccacaggcccggauaccacacccaaacggcaggaccuuggcacuugggaaaauuggagcuggauuucaacuauugcgaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauuguagggguucucuucacguuugugcuccuucucucagggcaaauaacauggagagauaugacacacacacucauaaugauuggguccaacgcuuccgacaggaugggaaugggcgucaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcaaauggaauugcucuggggcucaugacucuaaaacugauaacacaauuugagacauaucaguuguggacggcauuagucuccuuaacauguucaaacacaauuuucacauugacuguugccuggagaacagcuacccuaauucuggccggaguuucgcuuuugccacugugccagucuucgaguaugaggaaaacagauuggcucccaaugacuguggcagcuaugggagucccacccuuaccacuuuuuaucuucagcuugaaagacgcacccaaaaagaggagcuggccacugaaugagggagugauggcuguugggcuugugagcauucuagcuaguucucuccuuaggaaugaugugcccauggcuggaccacuaguggccgggggcuuguugauagcguguuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacaucuuaacagugcucuuaaaaacagcauugcuaauaguaucaggcaucuuuccauacuccauacccgccacacuauugguuuggcauacuuggcaaaagcaaacccaaagaucuggcguucuaugggacgugcccagccccccagaaacacagaaagcagaacuggaggagggggucuauaggaucaaacaacagggaauuuuugggaaaacccaagugggaguuggagugcagaaagaaggagucuuccacaccauguggcacgucacaagaggggcaguguugacgcacaaugggaaaagacuggaaccaaacugggccagcgugaaaaaagaucugauuucauauggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcagacaaaugcagaaccagacggaccgacaccggaauuggaagaggaaauguuuaaaaagcgaaaucuaaccauaauggaucuucauccugggucaggaaagacgcggaaauaucuuccagccauugucagagaagcaaucaagagacgcuuaagaacucuaauuuuggcaccaacaagagugguugcagcugagauggaagaagcauugaaaggacucccaauaagguaccaaacaacugcaacaaaaucugaacacacaggaagggagauuguugaucuaaugugccacgcaacauucacaaugcgcuuguuaucaccagucaggguuccaaauuacaauuugauaauaauggaugaggcccauuucacagauccagccagcauagcggcuagaggguacauaucaacucguguaggaaugggagaggcagcugcaauuuucaugacagcaacacccccuggaacugcugaggccuuuccccagagcaacgcuccaauucaagaugaagaaagagauaucccggaacguucauggaauucaggcaaugaauggauuaccgacuuuguugggaagacggugugguucgucccuagcaucaaagccggaaaugacauagcaaacugccugcgaaaaaauggaaaaaagguuauucaacuuaguaggaagacuuuugauacagaauaccaaaagaccagacugaaugauugggacuucguggugacgacagauauuucagaaaugggagcuaauuuuaaagcggauagagugauugacccaagaagaugucucaagccaguaauuuugacagauggacccgagcgagugauccuggcuggaccaaugccagucaccgcagcgagcgccgcgcaaaggagagggagaguuggcagaaacccacaaaaagaaaaugaccaguacauauucacgggccagccucucaacaaugaugaagaccaugcucacuggacagaagcaaaaaugcugcuagacaacaucaacacaccagaagggaucauaccagcucucuuugaaccagagagggagaagucagccgcuauagacggugaauaccgccugaagggugagucuaggaagaccuucguggaacucaugaggaggggugaccucccaguuuggcuagcccacaaaguagccucagaagggaucaaauacacagauagaaaauggugcuuugauggagaacguaacaaucaaauuuuagaggagaacauggauguggaaaucuggacaaaggaaggagaaaggaaaaaauugagacccagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggugguagggccuacaggcaugcaguggaggaacuaccagaaacaauggaaacacuccuacuccugggacucaugaucuuauuaacagguggagcaaugcuuuucuugauaucagguaaaggaauuggaaagacuucaauaggacucauuuguguuauuguuuccagcggcauguuauggauggcugauguuccacuucaauggaucgcgucggcuauaguccuggaauuuuuuaugaugguguugcuuauaccagaaccagaaaaacaaagaacuccccaagacaaccaacucgcauaugucgugauaggcauacuuacacuggcugcgauaguagcagcuaaugaaaugggauuguuggaaacuacaaagagagauuuaggaaugucuaaagaaccaggugcuguuucuucuaccagcuauuuagauguagacuugcacccagcaucagccuggacauuguacgccguggccacaacaguaauaacaccaauguugagacacaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaauccacugacucucacagcggcaguacuucugcuaguuacacacuaugccauuauagguccaggauugcaggccaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguugaugagaacaucaugggcauugugugaagcucuaacccuagccacaggaccaauaacaacacucugggaaggaucaccuggaaaguuuuggaauaccacgauagcuguuuccauggcuaacaucuuuagagggagcuacuuagcaggagcugggcuugcuuuuucuaucaugaaaucaguuggaacaggaaggagaggaacggggucacaaggcgaaaccuuaggagaaaaauggaaaaagagauuaaaucagcuaucccggaaagaguuugaccuuuacaagaaaucuggaaucacugaaguggauagaacagaagcuaaagaaggguugaaaagaggagaaacaacacaucaugcuguguccagaggcagcgcaaaacuucaaugguucguggagaggaacauggucauuccagaaggaagagucauagacuuaggcuguggaagaggaggcuggucauauuacugcgcaggacugaaaaaagucacagaagugcgaggauacacaaaaggcggcccaggacacgaagaaccaguaccuaugucuacauauggauggaacauagucaaguuaaugaguggaaaggacguguuuuaucuuccaccugaaaagugugacacccuauugugugacauuggagaaucuucaccuaguccaacaguggaagaaagcagaacuauaagaguuuugaagaugguugagccauggcuaaaaaacaaccaguuuugcauuaaaguauuaaacccuuacaugccaacugugauugagcaccuagaaagacugcaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauggagaaagauguggauuugggagcaggaacucgacaugucaaugcggaaccagaaacacccaacauggacgucauuggagaaagaauaaaaaggaucaaggaagagcauaguucaacauggcacuaugaugaugaaaauccuuauaaaacgugggcuuaccauggauccuaugaagucaaagccacaggcucagccuccuccaugauaaauggagucgugaaacuucucacaaaaccaugggaugugguucccauggugacacagauggcaaugacagacacaacuccauuugggcagcaaagaguuuucaaagagaaaguagacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcagcuaugggagcuguuuuuacagaggagaaccaaugggauagugcgagagcugcuguugaggacgaggaauucuggaaacuuguggacagagaacgugaacuccacagauugggcaaguguggaagcugugucuacaacaugaugggcaagagagaaaagaaacucggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuugagagacaucucuaagauacccggaggagccauguaugcugaugacacagccgguugggacacaagaauaacagaagaugaccugcacaacgaggaaaaaaucacacaacaaauggacccugaacacagacgauuagcgagcgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucaggcagauggaaggggaaggcguguugucgaaggcagaccucgaggacccucaccugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcaucuaacgccaucuguucagcaguaccaguccauuggguccccacaagcagaacgacaugguccauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggauuacaugccuucgaugaagagauucaggaaggaggaggagucagaaggagccaucugguaa

SEQ ID NO: 7754 - RNA, 9873 nt, Artificial Sequence
  derived and/or modified CDS sequence (wt) from DENV-3__JN662391__SS-prME
acaucgcucugucucaugaugauauugccagcagcacuugcuuuccacuugacuucacgagauggagagccgcgcaugaucguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugaccuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccucaggcacccaggguucaccauacuagcccuauuucuugcccauuacauaggcaccuccuugacccagaaggugguuauuuuuauacuacuaaugcuggucaccccauccaugacaaugagaugugugggagugggaaacagggauuuuguggaaggucugucaggagcuacauggguugacguggugcuagagcacggggggugugugaccaccauggcuaagaacaagcccacgcuggauauagagcuucagaagaccgaggccacccaacuggcgacccuaaggaagcuaugcauugaggggaaaauuaccaacauaacaacugacucaagaugccccacccaaggggaagcgguuuugccugaggagcaggaccagaacuacguguguaagcauacauacguagacagaggcugggggaacgguugugguuuguuuggcaagggaagcuugguaacaugugcgaaauuucaaugccuggaaccgauagagggaaaaguggugcaauaugagaaccucaaguauaccgucaucauuacagugcacacaggagaccaacaccaggugggaaaugaaacgcagggagucacggcugagauaacgccucaggcaucaaccacugaagccaucuugccugaauauggaacccuugggcuagagugcucaccacggacagguuuggacuucaaugaaaugaucuuacuaacaaugaagaauaaagcauggaugguacacagacaaugguuuuuugaccuaccucuaccauggacaucaggagcuacaacagaaacaccaacuuggaacaggaaggagcuccuugugacauucaaaaacgcacaugcgaaaaaacaagaaguaguuguccuuggaucacaagagggagcaaugcauaccgcacugacaggagccacagaaauccaaaacucaggaggcacaagcauuuuugcggggcacuuaaaguguagacuuaagauggacaaauuggaacucaaggggaugagcuaugcaaugugcacgaauaccuuuguguugaagaaagaagucucggaaacgcagcaugggacaauacucauuaaggucgaguacaaaggggaagaugcaccuugcaagauuccuuucuccacagaggaugaacaagggaaagcucacaauggcagacugaucacagccaacccaguggugacuaagaaggaggagccuguuaacauugaggcugaaccuccuuuuggggaaaguaauauaguaauuggaauuggagacaaugccuugaaaaucaacugguacaagaagggaagcucuauugggaagauguucgaggcuacugccagaggugcaaggcgcauggccaucuugggagacacagcuugggacuuuggaucagugggugguguucugaacucauuaggcaaaauggugcaccaaauauucggaagugcuuacacagcccuauucaguggagucuccugggugaugaaaauuggaauagguguucucuugacuuggauaggguugaauucaaaaaacacauccaugucauuuucaugcauugcgauaggaaucaucacacucuaucugggagcagugguacaagcugacauggggugugucauaaacuggaaaggcaaagaacuuaaaugcggaaguggaauuuucgucaccaacgagguccauaccuggacagagcaguacaaauuccaagcggauuccccaaaaagauuggcgacagcuauugcaggcgcuugggaaaauggagugugcggaauuaggucaacaaccagaauggagaaucucuuguggaagcagauagccaaugaacugaacuacauauuaugggaaaauaauauuaaauuaacgguaguugugggcgacacaauuggggucuuggagcaaggaaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaacuaacauauggcugaaacuccgagagguguacacccaaaugugugaccacaggcuaaugucggcagccgucaaggaugagagggccgugcaugccgacaugggcuauuggauagaaagccaaaagaauggaaguuggaagcuagaaaaagcaucccucauagaggugaaaaccugcacauggccaaaaucacacacucuuuggagcaacggugugcuagagagugacaugaucauuccaaagagucuagcugguccuauuucgcaacacaacuacaggcccggguaccacacccaaacggcaggacccuggcacuuaggaaaauuggagcuggacuucaacuauugugaaggaacaacaguugucaucacagaaaacugugggacgagaggcccaucauugagaacaacgacagugucaggaaaguugauacacgaaugguguugccgcucgugcacacuuccuccucugcgauacaugggagaagacggcuguugguaugguauggaaaucagacccaucagugagaaagaagagaacaugguaaagucuuuagucucagcgggaaguggaaagguagacaauuucacaaugggugucuugugcuuggcaauccucuuugaagaggugaugagaggaaaauuugggaagaaacacaugauugcagggguuuuccucacguuuaugcuccuucucucagggcaaauaacauggagagacauggcgcacacacuaauaaugauuggguccaacgccucugacaggaugggaaugggcgucaccuaucuagcuuuaauugcaacauuuaaaauccagccauuccuggcuuugggauuuuuccuaagaaaacugacaucuagagagaauuuacuguuaggaguuggauuggcuauggcaacaacgauacaacugccagaggacauugaacaaauggcaaauggaaucgcccuagggcucauggcucuuaaauugauaacacaauuugaaacauaccaauuauggacagcauuaaucuccuuaacguguucaaauacaauuuucacguugacuguugccuggagaacagccacccugauuuuggccggaguuucacuuuuaccagugugccagucuucgagcaugaggaaaacagacuggcuuccaaugacaguggcagcuaugggagucccaccccuaccacucuuuauuuuuagcuugaaagacacacucaaaaggagaagcuggccacugaaugaaggggugauggcuguugggcuugugagcauucuggccaguucucuccuuagaaaugacgugcccauggcuggaccauuaguggccgggggcuuguugauagcgugcuacgucauaacuggcacgucagcagaccuuacaguagaaaaagcagcagauguaacaugggaggaagaggcugagcaaacaggagugucccacaacuuaaugaucacaguugaugaugauggaacaaugagaauaaaagaugaugagacugagaauauucugacagugcuuuugaagacagcauuacuaauaguaucagguaucuuuccauacuccauacccgcaacauuguuggucuggcauacuuggcaaaagcaaacccaaagauccgguguuuuaugggacguacccagccccccagagacacagaaagcagaacuggaagaaggggucuauaggaucaaacagcaaggaauucuugggaaaacccaaguagggguuggaguacaaaaagaaggagucuuccacaccauguggcacgucacaagaggggcaguguugacacauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacauuucagaccacaacaggggaaauaggagcaauugcacuggauuucaagccuggaacuucagggucuccuaucauaaacagagagggaaagguagugggacuauauggcaauggagugguuacaaagaauggcggcuacgucagcggaauagcgcaaacaaaugcagaaccagauggaccgacgccagaguuggaagaagagauguucaaaaagcgaaaucuaaccauaauggaucuucauccugggucaggaaagacacggaaauaccuuccagccauuguuagagaggcaaucaagagacguuuaagaacucuaauuuuggcaccgacaagggugguugcagcugaaauggaagaagcauugaaagggcucccaauaagguaccaaacaacagcaacaaaaucugaacacacgggaagagagauuguugaucuaaugugccacgcaacguucacgaugcgcuugcugucaccaguuaggguuccaaauuacaacuugauaauaauggaugaggcccauuucacagacccagccaguauagcggccagaggguacauaucaacucguguuggaaugggagaggcagccgcaauuuucaugacggcaacgcccccuggaacagcugaugccuuuccucagagcaacgcuccaauucaagaugaagaaagggacauaccagaacgcucauggaauucaggcaaugaauggauuaccgacuucgccgggaaaacggugugguuuguccccagcaucaaagccggaaaugacauagcaaacugcuugcgaaagaacgggaaaaaggucauucaacuuaguaggaagacuuuugauacagaauaucagaagacuaaacuaaaugauugggacuuuguggugacaacugacauuucagaaaugggggccaauuucaaagcagauagagugaucgacccaagaagaugucuaaaaccagugauccugacagauggaccagagcgggugauccuggcuggaccaaugccagucaccguggcgagugcugcgcaaaggagagggagaguuggcaggaacccacaaaaagaaaaugaccaguacauauucacgggccagccucucaacaaugaugaagaccaugcucacuggacagaagcaaaaauguugcuggacaacaucaacacuccagaaggaaucauaccagcucucuuugaaccagaaagggagaagucagccgccauagacggugaauaucgccugaagggugaauccaggaagacuuucguggaacucaugaggaggggugaccuuccaguuugguuagcucacaaaguagcaucagaagggaucaaauacacagauagaaaauggugcuuugauggacagcguaacaaucaaauuuuagaggaaaacauggacguggaaaucuggacaaaggaaggagaaaagaaaaaauuaagaccuagguggcuugaugcccgcacuuauucagaucccuuagcacucaaggaauucaaggacuuugcggcuggcagaaagucaaucgcccuugaucuugugacagaaauaggaagagugccuucacaccuagcccacagaacgagaaacgcucuggacaaucuggugaugcugcacacgucagaacauggcgguagggccuacaggcaugcgguggaggaacuaccagaaacaauggaaacacuccuacucuugggacucaugaucuuacugacagguggagcaaugcuuuucuugauaucagguaaagggauuggaaagacuucaauaggacucauuugugugauugcuuccagcggcaugcuguggauggccgaaaucccacuccaauggaucgcgucggcuauaguccuggaguuuuuuaugaugguguugcuuauaccagaaccagaaaagcagagaaccccccaagacaaccaacucgcauaugucguaauaggcauacuuacauuggcugcaauaauagcggccaaugaaaugggacuguuggaaacuacaaagagagauuuaggaaugucuaaggagccagguguuguuucuccaacuagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcguaccacuauuggcauuggguugcuauucacaagugaacccauugacucuaacagcggcaguacuuuugcuaguuacacauuaugcuauuauagguccaggacugcaggcaaaagccacucgugaagcucaaaaaaggacagcugcuggaauaaugaagaauccaacgguggaugggauaauaacaauagaccuagauccuguaauauaugauucaaaauuugaaaagcaacugggacaggucaugcuccugguuuugugugcaguucaacuguuguuaaugagaacaucaugggccuugugugaagcccuaacuuuagcuacaggaccaauaacaacacucugggaaggaucaccugggaaguucuggaauaccacgauagcuguuuccauggcgaacauuuuuagagggagcuauuuagcaggagcugggcuugccuuuucuauuaugaaaucaguuggaacaggaaaaagaggaacaggcucucaaggugaaacuuugggagaaaaauggaaaaagaaacugaaucaauuaucccggaaagaguuugaccuuuacaagaagucuggaaucacugaaguggauagaacagaagccaaagaaggguugaaaagaggagaaacaacacaucaugccguguccagagguagugcaaaacuucaaugguuuguggagagaaacauggucauucccgaaggaagagucauagaccugggcuguggaagaggaggcuggucauauuacugugcaggacugaaaaaagucacagaagugcgaggauacacaaaaggcgguccaggacacgaagaaccagugccuaugucaacacauggauggaacauaguuaaguuaaugaguggaaaggauguguuuuaucuuccaccugaaaagugugacacccuguugugugacauuggagaauccucaccaagcccaacaguggaagaaagcagaacuauaagaguuuugaagaugguugaaccauggcugaaaaacaaccaguuuugcauuaaaguauugaacccuuacaugccagccgugauugagcaccuagagagacuacaaaggaaacacggaggaaugcuugugagaaauccacuuucacgaaacuccacgcacgaaauguacuggauaucuaaugguacagguaacauugucucuucagucaacaugguauccagacuguuacugaacagguucacgaugacacacaggagaccuaccauagagaaagauguggacuuaggagcaggaacucgacauguuaaugcggaaccagaaacacccaacauggaugucauuggggaaagaauaagaaggaucaaggaggagcauaauucaacauggcacuaugaugacgaaaaccccuacaaaacgugggcuuaccacggaucuuaugaagucaaggccacaggcucagccuccuccaugauaaauggagucgugaaacuucucacuaaaccaugggauguggugcccauggugacacagauggcaaugacagauacaacuccauuuggccagcagagaguuuuuaaagagaaaguggacaccaggacacccaggccuaugccagggacaagaaagguuauggagaucacagcggaguggcucuggagaacccugggaaggaacaaaagacccagguuaugcacaagggaagaguuuacaaaaaaggucagaaccaacgcagccaugggugccguuuucacagaggagaaccaaugggacagugcgaaagcugcuguugaggaugaagaauuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauuccuaaaugaagaccacugguucucgcgugaaaacuccuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucacacagcaaaugaacccugaacacaggcuguuagcgaacgcuauauuuaagcucacauaccaaaacaaaguggucaaaguucaacgaccgacuccaacgggcacgguaauggacaucauaucuaggaaagaccaaagaggcaguggacaggugggaacuuauggucuaaauacauuuaccaacauggaagcccaguuagucagacaaauggaaggagaaggugugcugucaaaggcagaccucgagaacccucaucugccagaaaagaaaauuacacaaugguuggaaaccaaaggaguggagagguuaaaaagaauggccauuagcggggaugauugcguagugaaaccaauugaugacagguucgcuaacgcccugcuugcucugaacgauaugggaaagguucggaaagacauaccucaauggcagccaucaaagggauggcaugacuggcagcagguucccuucugcucccaccacuuucaugaauugaucaugaaagauggaagaaaguuggugguucccugcagaccccaggacgaacuaauaggaagagcaagaaucucucaaggagcgggauggagccuuagagaaaccgcauguuuggggaaagccuaugcccaaauguggagucucauguauuuucacagaagagaucucagacuagcguccaaugccauauguucagcaguaccaguccacuggguccccacaaguagaacgacauggucuauucaugcucaccaucaguggaugacuacagaagacaugcuuacuguuuggaacaggguguggaucgaggacaauccauggauggaagacaaaacuccaguuacaaccugggaaaauguuccauaccuagggaagagagaagaccaauggugcggaucacuuauuggucucacuuccagagcaaccugggcccagaacauauccacagcaauucaacaggugagaagccuuauaggcaaugaagaguuucuggacuacaugccuucaaugaagagauucaggaaggaggaggagucggagggagccauuugguaa

SEQ ID NO: 7755 - RNA, 9873 nt, Artificial Sequence
  derived and/or modified CDS sequence (wt) from DENV-3__AY858043__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccccauguuggcaugggacuggacacacgcgcccaaaccuggaugucggcugaaggagcuuggaggcaagccgagaagguagagacaugggcccuuaggcacccaggguucacaauacuagcccuauuucuugcccauuauauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuaccauggcuaagaacaagcccacgcuggacauagagcuccagaagaccgaggccacccaacuggcaacccuaaggaaacuaugcauugagggaaaaaucaccaacgugacaacugacucaaggugccccacccaaggggaagcgauucuaccugaggagcaggaccagaacuacguguguaggcacacauacguggacagaggcuggggaaacgguugugguuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccguugaagccaucuuaccugaauauggaacccuugggcuagaaugcucaccacggacagguuuggauuucaaugagaugauuuuguugacaaugaagaacaaagcauggaugguucauagacaaugguuuuuugaccuaccucuaccauggacaucaggggcuacaacagaaacaccaaccuggaauaagaaagagcuucuugugacauucaaaaaugcacacgcaaaaaaacaagaaguaguaguccuuggaucgcaagaaggagcaaugcacacagcacugacaggagccacagagauccaaaccucaggaggcacaaguauuuuugcggggcacuugaaaugcagacucaagauggauaaauuggaacucaaggggaugagcuaugcaaugugcucaaaugccuuuguguugaagaaagaagucucugaaacacaacaugggacaauacucauuaaggucgaguacaaaggggaagacgcaccuugcaaaauuccuuucuccacggaggauggacaagggaaaguccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgaucgggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuucaguggagucuccuggauaaugaaaauuggaauagguguccuuuuaacuuggauaggguugaauucaaaaaacacuucuaugucauuuucaugcauugugauaggaaucaucacacucuaucugggagccguggugcaggcugacauggggugugucauaaacuggaaaggcaaagaacucaaauguggaaguggaauuuucguuacuaaugagguccacaccuggacagagcaauacaaauuucaagcagacucccccaaaagacuggcgacagccauugcaggcgccugggagaauggagugugcggaaucaggucgacaacuagaauggagaaccucuuguggaagcaaauagccaaugaacuaaacuacauacuaugggaaaacaacaucaaauuaacgguaguugugggugauauaauuggggucuuagagcaagggaaaagaacacuaacaccacaacccauggagcuaaaauauucauggaaaacauggggaaaggcgaaaguagugacagcugaaauacaaaauuccuccuuuauaauagaugggccaaacacaccagaguguccaaaugccucaagagcauggaaugugugggagguggaagauuacggguucggagucuucacaacuaauauauggcugaaacuccgagagauguacacccaacuaugugaccacaggcuaaugucggcagccguuaaggaugagagagccguacacgccgacaugggcuauuggauagaaagccaaaagaaugguaguuggaagcuagagaaggcaucucucauagaggugaaaaccuguacauggccaaaaucacacacucucuggagcaaugguguguuggagagugacaugauuaucccaaagagucuggcuggucccaucucgcaacacaacuacaggcccggauaccacacccaaacggcaggacccuggcaccuaggaaaauuggagcuggacuucaacuauugugaaggaacaacaguugucaucacagaaaauugugggacaagaggcccaucacugaggacaacuacagugucagggaaauugauacacgaaugguguugccgcucgugcacacuuccuccccugcgauauaugggagaagacggcugcugguauggcauggaaauuagaccuauuaaugagaaagaagagaacaugguaaagucuuuagucucagcagggaguggaaagguggauaacuucacaaugggugucuugugucuugcaauccucuuugaagagguaaugagaggaaaauucgggaaaaagcacaugauugcagggguucucuucauguuugugcuccuucucucagggcaaauaacauggagagacauggcgcgcacacucauaaugauuggauccaacgccucugacagaaugggaaugggcgucacuuaccuagcauugauugcaacauucaaaauucagccauuuuuggcuuugggauucuuccugaggaaacugacaucuagagaaaauuuauuauugggaguuggguuggccauggcaacaacguugcaacuaccagaggacauugaacaaauggcgaauggaauagccuuggggcuuauggcucuuaaauugauaacacaauuugaaacauaccaacuauggacggcauuagucucccuaacguguucaaacacaauuuucacguugacugucgccuggagaacagccacccugaucuuggccggaauuucgcuuuugccagugugccagucuucgagcaugaggaaaacagauuggcucccaaugacuguggcagcuaugggaguuccaccucuaccacucuuuauuuucaguuugaaagacacacucaaaaggagaagcuggccacugaaugagggggugauggccguuggacuugugagcauucuagcaaguucucuccuuaggaaugacguacccauggcuggaccauuaguggcugggggcuuguugauagcgugcuacgucauaacuggcacgucagcagaccuuacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggagucuuccacacuauguggcacgucacaagaggagcaguguugacauacaauggaaaaagacuggaaccaaacugggcuagcgugaaaaaagaucugauuucauacggaggcggauggagacugagugcacaauggcgaaaaggagaagaggugcagguuauugcuguagagccugggaagaacccaaagaacuuucaaacuaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaaugcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuagcaccaacaagggugguugcagcugagauggaagaagcauugaaagggcucccaauaagguaucaaacaacugcaacaaaaucugaacacacagggaaagagauuguugaucuaaugugucacgcaacguuuacaaugcguuugcugucaccagucagaguuccaaacuacaacuugauaauaauggaugaggcucauuucacagacccagccaguauagcggcuagaggguacauaucaacucguguaggaaugggagaagcagccgcaauuuucaugacagccacaccuccuggaacagcugaugcuuuuccucagagcaacgcuccaauucaagaugaagaaagagacauaccagaacgcucauggaauucaggcaaugauuggauuacugacuuugccggaaagacugugugguuuguccccagcaucaaagcuggaaacgacauagcaaacugcuugcggaaaaauggaaaaaagguuauucaacuuaguaggaaaacuuuugacacagaauaucaaaagacuaaacuaaaugauugggacuuuguggugacaacagacauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggagaggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcucgcacuuacucagaucccuuagcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagaacacggugggagggccuacaggcaugcaguggaggaauuaccagaaacaauggaaacauucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuaauaccagaaccagaaaagcagagaacuccccaagacaaucagcuugcauaugucgugauaggcauacuuacauuggcugcgauaguagcagccaaugaaaugggauuguuggaaaccacaaagagagauuuggggauguccaaagaaccagguguuguuucaccaaccagcuauuuggauguggauuugcacccagcaucagccuggacauuguacgcuguggccacaacaguaauaacaccaauguugagacauaccauagagaauucuacagcaaaugugucccuggcagcuauagccaaccaggcagugguccugauggguuuagacaaaggauggccgauaucgaaaauggauuuaggcgugccacuauuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcguuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugagacuuugggagaaaaguggaaaaagaaauugaaucaacuaucccggaaagaguuugaccucuacaagaaauccggaaucacugaaguggauagaacagaagccaaagaaggguugaaaagaggagaaacaacacaccaugccguauccagaggcagcgcgaaacuucaaugguucguggagagaaacauggucauuccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacuuuauugugugacauuggagaaucuucaccaagcccaacaguggaagagagcagaaccauaagagucuugaaaaugguugaaccauggcuaaaaaauaaccaguuuugcauuaaaguauugaacccuuacaugccaacuguaauugagcaccuagaaagacuacaaaggaagcaugggggaaugcuugugagaaauccacucucacgaaacuccacgcacgaaauguacuggauaucuaauggcacaggcaacaucgucucuucagucaacaugguauccagacugcuacugaacagauucaccaugacauauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaacccccuuuggccagcaaaggguuuuuaaagagaaaguggacaccaggacacccaaacccaugccaggaacaagaaagguuauggagaucacagcggaauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacagggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuauacaaugguuggaaaccaaaggaguagagagguugaaaagaauggccaucagcggggaugauugcguggugaaaccaaucgacgauagguucgccaaugcccugcuugcccugaaugacaugggaaaaguuaggaaggacauaccccaauggcagccaucgaggggauggcaugauuggcaacaggucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugcuuagggaaagccuacgcccagaugugggcucucauguauuuucacagaagagaucuuagacuggcauccaacgccauauguucagcagugccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcucagaacauacuuaccgcaauccaacagguaagaagccuuauaggcaaugaagaguuccuggacuacaugccuucgaugaagagauucaggaaggaggaggagucagagggagccauuugguaa

SEQ ID NO: 7756 - RNA, 9873 nt, Artificial Sequence
  derived and/or modified CDS sequence (wt) from DENV-3__AY858044__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacgaucacuuacaaaugcccccucauuacugaaguggagccugaagacauugacugcuggugcaaccucacaucgacgugggugaccuacggaacgugcaaccaagcuggagagcauagacgcgacaagagaucgguggcguuagcuccucauguuggcaugggacuggacacacgcgcccaaaccuggaugucggcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuaccauggcuaagaacaagcccacgcuggacauagagcuccagaagaccgaagccacccaacuggcaacccuaaggaaacuauguauugaggggaaaaucaccaacgugacaaccgacucaaggugccccacucaaggggaagcgauucuaccugaggagcaggaccagaacuacguguguaagcacacauacguggacagaggcuggggaaacgguuguggcuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacaaugguuuuucgaccuaccucuaccauggacaucaggggcuacaacagaaacaccaaccuggaauaagaaagagcuucuugugacauucaaaaaugcacacgcaaaaaaacaagagguaguaguccuuggaucgcaagagggagcaaugcacacagcacugacaggagccacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggaccauacucauuaaggucgaguacaaaggggaagacgcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccuuuuaacuuggauaggguuaaauucaaaaaacacuucuaugucauuuucaugcauugugauaggaaucaucacacucuaucugggagccguggugcaagcugauauggggugugucauaaacuggaaaggcaaagaacucaaauguggaaguggaauuuucgucacuaaugagguccacaccuggacagagcaauacaaauuucaggcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaaacuucgagagauguacacccaacuaugugaccacaggcuuaugucggcagcuguuaaggaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuagagagugacaugaucaucccaaagagucuggcugguccuaucucgcaacacaacuacaggcccggauaccacacucaaacggcaggacccuggcaccuaggaaaauuggagcuggacuucaacuauugugaaggaacaacaguugucaucacagaaaacugugggacaagaggcccaucacugaggacaacaacagugucagggaaguugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguggauaacuucacaaugggugucuugugucuugcaauccucuuugaagagguaaugagaggaaaauuugggaaaaagcacaugauugcagggguucucuucauguuugugcuccuucucucagggcaaauaacauggagagacauggcgcgcacacucauaaugauuggauccaacgccucugacagaaugggaaugggcgucaccuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuagucucccuaacguguucaaauacaauuuucacguugacuguugccuggagaacagccacccugaucuuggccggaauuucgcuuuugccagugugccaguccucgagcaugaggaaaacagauuggcucccaaugacuguggcagcuaugggaguuccaccucuaccacuuuuuaucuucaguuugaaagacacacuuaaaaggagaagcuggccacugaaugagggggugauggccguuggacuugugagcauccuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacaguacuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccauacuauguggcacgucacaagaggggcaguguugacauacaauggaaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagauggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcauugaaagggcucccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaaucuucaugacagccacacccccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagauauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuggcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagagcacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuuauaccagagccagaaaagcagagaacuccccaagacaaucaacucgcauaugucgugauaggcauacuuacauuggcugcaauaguagcagccaaugaaaugggauuguuggaaaccacaaagagagauuuagggauguccaaagaaccagguguugucucgccaaccagcuacuuggauguggauuugcacccagcaucagccuggacauuguacgcuguggccacaacaguaauaacaccaauguugagacauaccauagagaauucuacagcaaaugugucccuggcagcuauagccaaccaagcagugguccugauggguuuagacaaaggauggccgauaucgaaaauggacuuaggcgugccucuguuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugcgaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacucugggagaaaaguggaaaaagaaauugaaccaauuaucccggaaagaguuugaccucuacaagaaauccggaaucacugaaguggauagaacagaagccaaagaaggguugaaaagaggagaaacaacacaccaugccguauccagaggcagcgcaaaacuucaaugguucguggagagaaauauggucauuccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagagagcagaaccauaagagucuugaaaaugguugaaccauggcuaaaaaauaaccaguuuugcauuaaaguauugaacccuuacaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcgggauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacaaggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaaugaggaaaaaaucacacagcaaauggacccugaacacaggcaguuggcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaagaauggcuaucagcggggaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaauugguaguccccugcagaccccaggaugaauuaauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcucagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7757 - RNA, 9873 nt, Artificial Sequence
  derived and/or modified CDS sequence (wt) from DENV-3__AY858045__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacgaucacuuacaaaugcccccucauuacugaaguggagccugaagacauugacugcuggugcaaccucacaucgacgugggugaccuacggaacgugcaaccaagcuggagagcacagacgcgauaagagaucgguggcguuagcuccucauguuggcaugggacuggacacacgcgcccaaaccuggaugucggcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccaucuaugacaaugagaugugugggaguaggaaacagagauuuuguggaaggccuaucaggagcuacguggguugacguggugcucgaacacggugggugugugacuaccauggcuaagaacaagcccacgcuggacauagagcuccagaagaccgaagccacccaacuggcaacccuaagaaaacuauguauugaggggaaaaucaccaacgugacaaccgacucaaggugccccacucaaggggaagcgauucuaccugaggagcaggaccagaacuacguguguaagcacacauacguggacagaggcuggggaaacgguuguggcuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccuuggguuagaaugcucaccacggacagguuuggauuucaaugaaaugauuuuguugacaaugaagaacaaagcauggaugguacauagacaaugguuuuucgaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagccacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggccauuuuuaguggagucuccuggauaaugaaaauuggaauagguguccuuuuaacuuggauaggguuaaauucaaaaaacacuucuaugucauuuucaugcauugugauaggaaucaucacacucuaucugggagccguggugcaagcugauauggggugugucauaaacuggaaaggcaaagaacucaaauguggaaguggaauuuucgucacuaaugagguccacaccuggacagagcaauacaaauuccaggcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaaacuucgagagauguacacccaacuaugugaccacaggcuuaugucggcagcuguuaaggaugagagagccguacacgccgacaugggcuauuggauagaaagccaaaagaaugguaguuggaagcuagaaaaggcaucucucauagagguaaaaaccugcacauggccaaaaucacacacucucuggagcaaugguguguuagagagugacaugaucaucccaaagagucuggcugguccuaucucgcaacacaacuacaggcccggauaccacacucaaacggcaggaccuuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguggauaacuucacaaugggugucuugugucuugcaauccucuuugaagagguaaugagaggaaaauuugggaaaaagcacaugauugcagggguucucuucauguuugugcuccuucucucagggcaaauaacauggagagacauggcgcgcacacucauaaugauuggauccaacgccucugacagaaugggaaugggcgucacuuaccuagcauugauugcaacauuugaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcuuauggcucuuaaauugauaacacaauuugaaacauaccaacuauggacggcauuagucucccuaacguguucaaauacaauuuucacguugacuguugccuggagaacagccacccugaucuuggccggaauuucgcuuuugccagugugccaguccucgagcaugaggaaaacagauuggcucccaaugacuguggcagcuaugggaguuccaccucuaccacuuuuuaucuucaguuugaaagacacacuuaaaaggagaagcuggccacugaaugagggggugauggccguuggacuugugagcauccuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacaguacuuuugaaaacagcauuacuaauagugucaggcauuuuuccauacuccauaccugcaacacuuuuggucuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccacacuauguggcacgucacaagaggggcaguguugacauacaauggaaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagauggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcauugaaagggcucccaauaagguaucaaacaacugcaacaaaaucugaacacacagggaaagagauuguugaucuaaugugucacgcaacguucacaaugcgcuugcugucaccagucagaguuccaaacuacaacuugauaauaauggaugaggcucauuucacagacccagccaguauagcggcuagaggguacauaucaacucguguaggaaugggagaggcagccgcaaucuucaugacagccacacccccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagauauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauauauauucacgggccagccccucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuggcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagagcacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuggggauguccaaagaaccagguguugucucgccaaccagcuauuuggauguggauuugcacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccucuguuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguuuuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagagauugaaucaauuaucccggaaagaguuugaccucuacaagaaauccggaaucacugaaguggauagaacagaagccaaagaaggguugaaaagaggagaaauaacacaccaugccguauccagaggcagcgcaaaacuucaaugguucguggagagaaauauggucauuccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagaaagcagaaccauaagagucuugaaaaugguugaaccauggcuaaaaaauaaccaguuuugcauuaaaguauugaacccuuauaugccaacugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauacaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaagguuauggagaucacagcgggauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacaaggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguugaaaagaauggccaucagcggggaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcucagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7758 - RNA, 9873 nt, Artificial Sequence
  derived and/or modified CDS sequence (wt) from DENV-3__AY858046__SS-prME
acaucgcucugucucaugaugauguuaccagcaacacuugcuuuccacuugacuucacgagauggagagccgcgcaugauuguggggaagaaugaaagaggaaaaucccuacucuuuaagacagccucuggaaucaacaugugcacacucauagccauggauuugggagaaaugugugaugacacgaucacuuacaaaugcccccucauuacugaaguggagccugaagacauugacugcuggugcaaccucacaucgacgugggugaccuacggaacgugcaaccaaguuggagagcauagacgcgauaagagaucgguggcauuagcuccucauguuggcaugggacuggacacacgcgcccaaaccuggaugucggcugaaggagcuuggagacaagucgagaagguagagacaugggccuuuaggcacccaggguuuacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuaccauggcuaagaacaagcccacgcuggacauagagcuccagaagaccgaagccacccaacuggcaacccuaaggaaacuaugcauugaggggaaaaucaccaacgugacaacugacucaaggugccccacucaaggggaagcgauucuaccugaggagcaggaccagaacuacguguguaagcacacauacguggacagaggcuggggaaacgguuguggcuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaacugucgaagccaucuuaccugaauauggaacccuugggcuagaaugcucaccacggacagguuuggauuucaaugaaaugauuuuguugacaaugaagaacaaagcauggaugguacauagacaaugguuuuucgaccuaccucuaccauggacaucaggggcuacaacagaaacaccaaccuggaauaagaaagagcuucuugugacauucaaaaacgcacacgcaaaaaaacaagaaguaguaguccuuggaucgcaagagggagcaaugcacacagcacugacaggagccacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggauuuuggaucaguaggugguguuuuaaauucacuagggaaaauggugcaccaaauauuuggaagugcuuacacagcccuuuuuaguggagucuccuggauaaugaaaauuggaauagguguccuuuuaacuuggauaggguuaaauucaaaaaacacuucuaugucauuuucaugcauugugauaggaaucaucacacucuaucugggagccguggugcaagcugauauggggugugucauaaacuggaagggcaaagaacucaaauguggaaguggaauuuucgucacuaaugagguccacaccuggacagagcaauacaaauuucaggcagacucccccaaaagacuggcgacagccauugcaggcgccugggagaauggagugugcggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaaacuucgagagauguacacccaacuaugugaccacaggcuuaugucggcagcuguuaaggaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuagagagugacaugaucaucccaaagagucuggcugguccuaucucgcaacacaacuacaggcccggauaccacacucaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguggauaacuucacaaugggugucuugugucuugcaauccucuuugaagagguaaugagaggaaaauuugggaaaaagcacaugauugcagggguucucuucauguuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagccuuggggcucauggcucuuaaauugauaacacaauuugaaacauaccaacuauggacggcauuagucucccuaacguguucaaauacaauuuucacguugacuguugccuggagaacagccacccugaucuuggccggaauuucgcuuuugccagugugccaguccucgagcaugaggaaaacagauuggcucccaaugacuguggcagcuaugggaguuccaccucuaccacuuuuuaucuucaguuugaaagacacacuuaaaaggagaagcuggccacugaaugagggggugauggccguuggacuugugagcauccuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaacuuaaugaucacaguugaugaugauggaacaaugagaauaaaagaugaugagacugagaacaucuuaacaguacuuuugaaaacagcauuacuaauagugucaggcauuuuuccauacuccauaccugcaacacuuuugguuuggcacacuuggcaaaagcaaacccaaagauccggcguccugugggacguacccagccccccagagacacagaaagcagaacuggaagaaggggucuauaggaucaagcagcaaggaauuuuuggaaagacccaaguggggguuggaguacaaaaagaaggaguuuuccacacuauguggcacgucacaagaggggcaguguugacauauaauggaaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagauggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcacugaaagggcucccaauaagguaucaaacaacugcaacaaaaucugaacacacagggaaagagauuguugaucuaaugugucacgcaacguucacaaugcguuugcugucaccagucagaguuccaaauuacaacuugauaauaauggaugaggcucauuucacagacccagccaguauagcggcuagaggguacauaucaacucguguaggaaugggagaggcagccgcaaucuucaugacagccacacccccuggaacagcugaugccuuuccucagagcaacgcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagauauuucagaaaugggagccaauuucaaagcagacagagugaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuggcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagagcacggugggagggccuacaggcaugcaguggaggaauuaccagaaacaauggaaacacucuuacuccugggacucaugauccuguuaacagguggggcgaugcucuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggaauguuggaaaccacaaagagagauuuggggauguccaaagaaccagguguugucucgccaaccagcuauuuggauguggauuugcacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccucuguuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacaccacgauagcuguuuccauggcgaacaucuuuagagggagcuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaauuacugaaguggauagaacagaagccaaagaaggguugagaagaggagaaauaacacaccaugccguauccagaggcagcgcaaaacuucaaugguucguggagagaaauauggucauuccugaaggaagagucauagacuugggcuguggaagaggaggcuggucauauuauugugcaggauugaaaaaaguuacagaagugcgaggauacacaaaaggcggcccaggacaugaagaaccaguaccuaugucuacauauggauggaacauagucaagcugaugaguggaaaggauguguuuuaucuuccaccugaaaagugugacacucuauugugugacauuggagaaucuucaccaagcccaacaguggaagagagcagaaccauaagagucuugaaaaugguugaaccauggcuaaaaaauaaccaguuuugcauuaaaguauugaacccuuauaugccaacugugauugagcaccuagaaagacuacaaaggaaacauggaggaaugcuugugagaaauccacucucacgaaacuccacgcacgaaauguacuggauaucuaauggcacaggcaacauugucucuucagucaacaugguauccagacugcuacugaacagauucacaaugacauauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaagggucuuuaaagagaaaguggacaccaggacacccaaacccaugccaggaacaagaaaggcuauggagaucacagcgggauggcuuuggagaacccugggaaggaacaaaagacccagauuaugcacgagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaacaaggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagacauuuccaagauacccggaggagcuauguaugcugaugacacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaaguccaguugaucagacaaauggaaggagaggguguguugucgaagacagaccucgagaacccucaucugcuagagaagaaaaucacacaaugguuggaaaccaaaggaguggagagguuaaaaagaauggccaucagcggagaugauugcguggugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaggaugaauuaauagggagagcgagaaucucucagggagcaggauggagccuuaaagaaacugcaugccuagggaaagccuacgcccaaaugugggcucucauguauuuucacagaagagaucuuagacuagcauccaacgccauauguucggcaguaccaguccauuggguccccacaagcagaacgacgugguccauccaugcucaccaucaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcucagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7759 - RNA, 9873 nt, Artificial Sequence
  derived and/or modified CDS sequence (wt) from DENV-3__AY858047__SS-prME
acaucgcucugucucaugaugauguuaccagcaacacuugcuuuccacuugacuucacgagauggagagccgcgcaugauuguggggaagaaugagagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucgguaugggacuggacacacgcgcccagaccuggaugucggcugaaggagcuuggagacaaguugagaagguagagacaugggccuuuaggcauccaggguucacaauacuagcccuauuucuugcccauuacauaggcacuuccuugacccagaaaguggucauuuucauacuacuaaugcuggucaccccauccaugacaaugagaugugugggagugggaaacagagauuuuguggaaggccuaucaggagcuacguggguugacguggugcucgaacacggugggugugugacuaccauggcuaagaacaagcccacgcuggacauagagcuccagaagaccgaggccacccaacuggcaacccuaaggaaacuauguauugagggaaaaaucaccaacgugacaaccgacucaaggugccccacccaaggggaagcgauucuaccugaggagcaggaccagaacuacguguguaagcacacauacguggacagaggcuggggaaacgguugugguuuguuuggcaagggaagcuugguaacaugcgcaaaauuucaauguuuggaauugauagagggaaaaguggugcagcaugagaaccucaaauacaccgucaucaucacagugcauacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaacaaagcauggaugguacauagacaaugguuuuuugaccuaccucuaccauggacaucaggggcuacaacagaaacaccaaccuggaauaagaaagagcuucuugugacauucaaaaacgcacacgcaaaaaaacaagagguaguaguccuuggaucgcaagagggagcaaugcacacagcauugacaggagcuacagagauccaaaccucaggaggcacaaguauuuuugcggggcacuugaaaugcagacucaagauggacaaauuggaacucaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccagugguaaccaagaaggaggagcccgucaauauugaggcagaaccuccuuuuggggaaaguaauauaauaauuggaauaggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcacuuuuuaguggagucuccuggauaaugaaaauuggaauagguguccuuuuaacuuggauaggguugaauucaaaaaacacuucuaugucauuuucaugcauugugauaggaaucaucacacucuaucugggagccguggugcaagcugacauggggugugucauaaacuggaaaggcaaagaacucaaauguggaaguggaauuuucguuacuaaugagguccacaccuggacagagcaauacaaauuucaagcagacuccccaaaaagauuggcgacagccauugcaggcgccugggagaauggagugugcggaaucaggucgacaaccagaauggagaaccucuuauggaagcaaauagccaaugaacuaaacuacauacuaugggaaaacaacaucaaauuaacgguaguugugggugauauaauugggaucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaagcuccgagaaauguacucccaacuaugugaccauaggcuaaugucggcagccguuaaggaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuggagagugacaugaucaucccaaagagucuggcugguccuaucucgcaacacaauuacaggcccggauaccacacccaaacggcaggaccauggcaccuaggaaaauuggagcuggacuucaacuauugugaaggaacaacaguugucaucacagaaaauugugggacaagagguccaucacugaggacaacaacagugucagggaaauugauacacgaaugguguugccgcucauguacacuuccuccccugcgauauaugggagaagacggcugcugguauggcauggaaauuagacccaucaaugagaaagaagagaacaugguaaagucuuuagucucagcagggaguggaaagguggauaacuucacaaugggugucuugugucuugcaauccucuuugaagagguaaugagaggaaaauucgggaaaaagcacaugauugcagggguucucuucacauuugugcuccuucucucagggcaaauaacauggagagacauggcacgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuguuauugggaguuggguuagccauggcaacaacguugcaacugccagaggacauugaacaaauggcgaauggaauagccuuggggcucauggcucuuaaauugauaacacaauuugaaacauaccaacuauggacggcauuagucucccuaauguguucaaacacaauuuuuacguugacuguugccuggagaacagccacccugauuuuggccggaauuucgcuuuugccauugugccagucuucgagcaugaggaaaacagauuggcuuccaaugacuguagcagcuaugggaguuccaccucuaccacuuuuuauuuucagucugaaagacacacucaaaaggagaagcuggccacugaaugaaggggugauggccguaggacuugugagcauucuagcaaguucucuccuuaggaaugacguacccauggcuggaccauuaguggcugggggcuugcugauagcgugcuaugucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauugcuaauagugucaggcauuuuuccauacuccauaccugcaacacuuuuggucuggcacacuuggcaaaagagaacccaaagauccggcguccugugggacguacccagucccccagagacacaaaaagcagaacuggaagaaggggucuauaggaucaagcagcaaggaauucuuggaaagacccaaguggggguuggaguacaaaaagaaggaguuuuccacacuauguggcacgucacaagaggagcaguguugacauacaauggaaaaagacuggaaccaaacugggcuagcgugaaaaaagaucugauuucauacggaggaggauggagacugagugcacaauggcaaaagggagaagaggugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauuuuggcaccaacaagggugguugcagcugagauggaagaagcauugaaagggcucccaauaagguaucaaacaaccgcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacaccuccuggaacagcugaugccuuuccccagagcaacgcuccaauucaagaugaagaaagagacauaccagaacgcucauggaauucaggcaaugauuggauuaccgacuuugccggaaagacugugugguuuguccccagcaucaaagcugggaaugacauagcaaacugccugcggaaaaauggaaaaaaggucauucaacuuaguaggaaaacuuuugacacagaauaucaaaagacuaaacuaaaugauugggacuuuguggugacaacagacauuucagagaugggagccaauuucaaagcagacagagugaucgacccaagaagaugucucaagccagucauuuugacagacggacccgagcgcgugauccuggcgggaccaaugccagucaccguagcgagugccgcgcaaaggagagggagaguuggcaggaacccacaaaaagaaaaugaccaauacauauucacgggccagccucucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaacauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcucacagaacgagaaacgcucuggacaaucuggugauguugcacacgucagagcacggugggagggccuacaggcaugcaguggaggaauuaccagaaacaauggaaacacucuuacuccugggacucaugauucuguuaacagguggggugaugcuuuucuugauaucaggcaaaggggucggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggacuguuggaaaccacaaagagagauuuggggauguccaaagaaccaggugucgcuucgccaaccagcuauuuggauguggauuugcacccagcaucagccuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacugggcugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggauggaauaaugacaauagaccuagauccuguaauauacgauucaaaauuugagaaacaauuaggacaaguuaugcuccugguucugugugcaguucaacuuuuguuaaugagaacaucaugggcauuuugugaagcucuaacccuagccacaggaccaauaacaacacucugggaaggaucaccugggaaguucuggaacacuacgauagcuguuuccauggcgaacaucuuuagagggagcuauuuagcaggagcugggcuugcuuuuucuaucaugaaaucaguuggaacgggaaagagaggaacagggucacaaggugaaacuuugggagaaaaguggaaaaagaaauugaaucaauuaucccggaaagaguuugaucucuacaagaaauccggaaucacugaaguggauagaacagaagccaaagaaggguugaaaagaggagagauaacacaccaugccguauccagaggcagcgcaaaacuucaaugguucguggagagaaacauggucauuccugaaggaagagucauagacuugggcuguggaagaggaggcuggucauauuauugugcaggauugaaaaaaguuacagaagugcgaggauacacaaaaggcggcccaggacaugaagaaccaguaccuauguccacauauggauggaacauagucaagcugaugaguggaaaggauguguuuuaucucccaccugaaaagugugacacucuauugugugacauuggagaaucuucaccaagcccaacaguggaggagagcagaaccauaagagucuugaaaaugguugaaccauggcuaaaaaauaaccaguuuugcauuaaaguauugaacccuuacaugccagcugugauugagcaccuagaaagacuacaaaggaaacauggaggaaugcuugugagaaauccacucucacgaaacuccacgcacgaaauguacuggauaucuaauggcacaggcaacaucgucucuucagucaacaugguauccagacugcuacugaacagauucacaaugacauauaggagaccuaccauagagaaagauguggauuuaggagcggggacccggcaugucaaugcggaaccagaaacacccaacauggaugucauuggggaaagaauaagaaggaucaaggaggagcauaguucaacauggcacuaugaugaugagaauccuuacaagacgugggcuuaccauggaucuuaugaaguuaaggccacaggcucagccuccuccaugauaaauggagucgugaaacuccucacgaaaccaugggauguggugcccacggugacacagauggcaaugacggacacgaccccuuuuggccagcaaaggguuuuuaaagaaaaaguggacaccaggacacccaaacccaugccaggaacaagaaaggucauggagaucacagcggaauggcuuuggagaacccugggaaggaacaaaagacccagauuaugcacgagagaggaguucacaaaaaaggucagaaccaacgcagcuaugggcgccguguucacagaggagaaccaaugggacagugcuaaagcugccguugaagaugaagaauucuggaaacucguggacagagaacgugaacuccacaaacugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagccauguaugcugacgacacagcugggugggacacaagaauaacagaagaugaccugcacaaugaggaaaaaaucacacagcaaauggacccugaacacaggcaguuagcaaacgcuauauuuaagcucacauaucaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaagaauggccaucagcggggaugauugcguagugaaaccaaucgacgacagguucgccaaugcccugcuugcccugaaugacaugggaaaaguuaggaaggacauaccccaauggcagccaucgaagggauggcaugauuggcaacaggucccuuucugcucccaccacuuucaugaauugauuaugaaagauggaagaaaguugguaguccccugcagaccucaagaugaauuaauagggagagcgagaaucucucagggagcaggauggagccuuaaagaaacugcaugccuagggaaagccuacgcccaaaugugggcucucauguauuuucacagaagagaucuuagacuagcauccaaugccauauguucagcaguaccaguccauuggguccccacaagcagaacgacgugguccauccaugcucaccaucaguggaugacuacagaagacaugcuuaucguuuggaacaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuacugcaauccaacagguaagaagccuuauaggcaaugaagaguuucuggacuacaugccuucgaugaagagauucaggaaggaggaggagucagagggagccauuugguaa

SEQ ID NO: 7760 - RNA, 9873 nt, Artificial Sequence
  derived and/or modified CDS sequence (wt) from DENV-3__HQ332170__SS-prME
acaucgcucugucucaugaugauauugccagcagcacuugcuuuccacuugacuucacgagauggagagccgcgcaugauuguggggaaaaaugaaagaggaaaaucccuacuuuuuaagacagccucuggaaucaacaugugcacacucauagccauggacuugggagagaugugugaugacacggucacuuacaaaugcccccauauuaccgaaguggaaccugaagacauugacugcugguguaaccucacaucaacaugggugacuuauggaacgugcaaucaagccggagagcauagacgcgacaagagaucaguggcguuagcuccccaugucggcaugggacuggacacacgcacccaaaccuggaugucggcugaaggagcuuggaggcaagucgagaagguagagacaugggcccuuaggcacccaggguucaccauacuagcccuauuucuugcccauuacauaggcacuuccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugaccaccauggccaagaacaagcccacguuggauauagagcuucagaagaccgaggccacccaacuggcgacccuaaggaagcuaugcauugaggggaaaaucaccaacauaacaacugacucaagauguccuacccaaggggaagcgguuuugccugaggagcaggaccagaacuacguguguaagcauacauacguagacagaggcugggggaauggaugugguuuguuuggcaagggaagcuugguaacaugugcgaaauuucaaugccuggaaccaauagagggaaaaguggugcaauaugagaaccucaaauacaccguuaucaucacagugcacacaggagaccaacaccaggugggaaaugaaacgcagggagucacggcugagauaacaccucaggcaucaaccacugaagccaucuugccugaauauggaacccuugggcuagaaugcucaccacggacagguuuggacuucaaugaaaugaucuugcuaacaaugaagaacaaagcauggaugguacauagacaaugguuuuuugaccuaccucuaccauggacaucaggagcuacaacggaaacaccaaccuggaacaggaaggaacuucuugugacauuuaaaaacgcacaugcgaaaaaacaagaaguaguuguccuuggaucgcaagagggagcaaugcauacugcauugacaggagccacagaaauccaaaacucaggaggcacaagcauuuuugcggggcacuuaaaauguagacuuaagauggacaaauuagaacucaaggggaugagcuaugcaaugugcacgaauaccuuuguguugaagaaagaagucucagaaacgcagcaugggacaauacucaucaaggucgacuacaaaggggaagauguaccuugcaagauuccuuucuccacagaggauggacaagggaaagcucacaauggcagacugauuacagccaacccaguggugacuaagaaggaggagccugucaauauugaggcugaaccuccuuuuggggaaaguaauauaguaauuggaauuggagacaacgccuugaaaauuaacugguacaagaagggaagcucuauugggaagauguucgaggccacugcuagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaauuggaauaggaguucucuugacuuggauaggguugaauucaaaaaacacauccaugucauuuucaugcauugcgauaggaaucauuacacucuaucugggagcuguggugcaagcugacacgggguguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauucuucuuucauaauagauggaccaaacacaccggaguguccaagcgccucaagagcauggaaugugugggagguggaagauuacggguucggagucuucacaaccaacauauggcugaaacuccgagagguguauacccaacaaugugaccauaggcuaaugucggcagccgucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaaugguguguuagagagugacaugaucauuccaaagagucuagcugguccuaucucgcaacacaacuacaggcccggguaccacacccagacggcgggacccuggcauuuaggaaaauuagagcuggacuucaacuauugugaaggaacaacagucgucaucacagaaaacugugggacaagaggcccaucauugagaacaacaacagugucagggaaguuaauacacgaauggugcugccgcucgugcacacuuccuccccugcgauacaugggagaagacgguugcugguauggcauggaaaucagacccaucagugagaaagaagagaacaugguaaagucuuuagucucagcgggaaguggagagguggacaacuucacaaugggugucuuguguuuggcaauccucuuugaagaggugaugagaggaaaauuugggaagaaacacaugauugcggggguuuucuucacguuuguacuccuucucucagggcaaauaacauggagagacauggcgcacacacuaauaaugauuggguccaacgcaucugacaggaugggaaugggcguuaccuaccuagcuuuaauugcaacauucaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauuaaucuccuuaacguguucaaauacaauuuuuacguugacuguugccuggagaacagccacccugauuuuggccggaguuucgcuuuuaccagugugccagucuucgagcaugaggaaaacagacuggcuuccaaugacaguggcagcuaugggaguuccaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauuaguggccggaggcuugcugauagcgugcuacgucauaacuggcacgucagcagaccucaccguagaaaaagcagcagauguaacaugggaggaagaggcugagcaaacaggagugucccacaacuuaaugaucacaguugaugaugauggaacaaugagaauaaaagaugaugagacugagaauaucuuaacagugcuuuugaaaacagcauuacuaauaguaucaggaaucuuuccauacuccauaccagcaacauuguuagucuggcauacuuggcaaaagcaaacccaaagauccggcguucuaugggauguaccuagcccuccagagacacagaaagcagaacuggaagaaggggucuauaggaucaaacagcaaggaauuuuugggaaaacccaaguagggguuggaguacagaaagaaggagucuuucacaccauguggcacguuacaagaggggcaguguugacguauaaugggaaaagacuggaaccaaacugggcuagcgugaaaaaagaucugauuucauacggaggaggauggagauugagcgcacaauggcaaaagggggaggagguacagguuauugccguagagccugggaagaacccaaagaacuuucaaacuaugccaggcacuuuucagacuacaacaggggaaauaggagcaauugcacuggauuucaagccuggaacuucaggaucuccuaucauaaacagagagggaaagguagugggacuguauggcaauggagugguuacaaagaaugguggcuacgucagcggaauagcgcaaacgaaugcagaaccagauggaccgacaccagaauuggaagaagagauguucaaaaagcgaaaucuaaccauaauggaucuucauccugggucaggaaagacacggaaauaccuuccagcuauuguuagagaggcaaucaagagacguuugagaacucuaauucuggcaccgacaagggugguugcagcugagauggaagaagcauugaaagggcucccaauaagguaccaaacaacagcaacaaaaucugaacacacaggaagagagauuguugaucugaugugccacgcaacguucacaaugcgucugcugucaccaguuaggguuccaaacuauaacuugauaauaauggaugaagcccauuucacagacccagccaguauagcugcuagaggguacauaucaacucguguuggaaugggagaagcagccgcaauuuucaugacagcaacgcccccuggaacagccgaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugccugcggaaaaacgggaaaaaggucauucaacuuaguaggaagacuuuugacacagaauaucagaaaacuaaacugaaugauugggacuuuguggugacgacugacauuucagaaaugggggccaauuucaaagcagauagagugauugacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaacacaccagaagggaucauaccagcucucuuugagccagaaagggagaagucagccgccauagacggugaguaucgccugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaagagaacauggauguggaaaucuggacaaaggaaggagaaaagaaaaaauugagaccuagguggcuugaugcccgcaccuauucagaucccuuagcacucaaggaauucaaggacuuugcggcuggcagaaagucaauagcccuugaucuugugacagaaauaggaagagugccuucacaccuagcucauagaacgagaaacgcucuggacaaucuggugaugcugcauacgucagaacauggcgguaaggccuacaggcaugcgguggaggaacuaccagagacaauggaaacacuccuacucuugggacucaugaucuuguugacagguggagcuaugcuuuucuuaauaucaggcaaagggauuggaaagacuucaauaggacucauuuguguaaucgcuuccaguggcauguuguggauggccgaaaucccacuccaauggaucgcgucggccauaguccuggaguuuuuuaugauggugcugcucauaccagaaccagaaaagcagagaaccccccaagacaaccaacucgcauaugucgugauaggcauacuuacauuggcagcaauaauagcagccaaugaaaugggauuguuggaaacuacaaagagagauuuaggaaugucuaaggagccagguguuguuucuccaaccagcuauuuagauguggacuugcacccagcaucagccuggacauuguacgcuguggccacuacaguaauaacaccaauguuaagacauaccauagagaauucuacagcaaaugugucccuggcagcuauagccaaccaggcagugguucugauggguuuggacaaaggauggccaauaucaaaaauggacuuaggaguaccccugcuggcauuagguugcuauucacaagugaacccacugacucuaacagcggcaguacucuugcugaucacacauuaugcuauuauagguccaggacugcaggcaaaagccacucgugaagcucagaaaaggacagcugcuggaauaaugaagaauccaacgguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggagcuauuuagcaggagcugggcuugcuuuuucuauuaugaaaucaguuggaacaggaaaaagaggaacaggcucacagggugaaacuuuaggagaaaaauggaaaaagaaguuaaaucaauuaucccggaaagaguuugaccuuuacaagaaaucuggaaucacugaaguggauagaacagaagccaaagaaggguugaaaagaggagaaauaacacaucaugccguguccagagguagcgcaaaacuucaaugguuuguggagagaagcauggucauucccgaaggaagaguuauagacuugggcuguggaagaggaggcuggucauauuacugugcaggacugaaaaaagucacagaagugcgaggauacacaaaaggcgguccaggacacgaagaaccaguaccuauguccacauauggauggaacauagucaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaagaacaaccaauuuuguauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaacaugguaucuagacugcuacugaacagguucacgaugacacacagaagacccaccaucgagaaagauguggauuuaggagcaggaacucgacauguuaaugcggaaccagaaacacccaacauggaugucauuggggaaagaauaaaaaggaucaaggaggagcauaauucaacauggcauuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagagucuuuaaagagaaaguggacaccaggacacccagguccaugccaggaacaagaaggguuauggggaucacagcggaguggcucuggagaacccugggaaggaacaaaaagcccagguugugcacaagggaagaguuuacaaaaaaggucagaacuaacgcagccaugggagccguuuucacagaggagaaccaaugggacagcgcgaaagcugcuguugaggaugaggauuuuuggaaacuuguggacagagaacgugaacuccacaaauugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaagcaguuagcgaacgcuauauuuaaacucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugauugcguagugaaaccaaucgaugacagguucgcuaaugcccugcucgcucugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaaugguguggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7761 - RNA, 9873 nt, Artificial Sequence
  derived and/or modified CDS sequence (wt) from DENV-3__AY858038__SS-prME
acaucgcucugucucaugaugauguuaccagcaacacuugcuuuccauuugacuucacgagauggagagccgcgcaugauuguggggaagaaugaaagaggaaaaucccuacuuuuuaagacagccucugggaucaacaugugcacacucauagccauggauuugggagagaugugugaugauacggucacuuacaaaugcccccucauuacugaaguggagccugaagacauugacugcuggugcaaccucacaucgacgugggugacuuacggaacgugcaaccaagcuggagagcauagacgcgauaaaagaucgguggcguuagcuccccaugucggcaugggacuggacacacguacucaaaccuggaugucggccgaaggagcuuggagacaagucgagaagguagagacaugggccuuuaggcacccaggguucacaauacuagcccuauuucuugcccauuacauaggcacuuccuugacccaaaaaguggucauuuucauacugcuaaugcuggucacuccauccaugacaaugagaugugugggaguaggaaacagagauuuuguggaaggccuaucaggagcuacguggguugacguggugcucgaacacggugggugugugacuaccauggcuaagaacaagcccacgcuggauauagagcuccagaagacugaggccacccaacuggcgacccuaaggaaacuaugcauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagcuugguaacaugcgcgaaauuucaauguuuggaaucaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccucgggcuagaaugcucaccacggacagguuuggauuucaaugaaaugauuuuguugacaaugaagaacaaagcauggaugguacauagacaaugguuuuuugaccuaccucuaccauggacaucaggggccacaacagaaacaccaaccuggaauaagaaagagcuucuugugacauucaaaaacgcacacgcaaaaaaacaagaaguaguaguccucggaucgcaagagggagcaaugcacacagcacugacaggagcuacagagauccaaaccucaggaggcacaaguauuuuugcggggcacuuaaaaugcagacucaagauggacaaauuggaacucaaggggaugagcuaugcaaugugcuuaaaugccuuuguguugaagaaagaagucuccgaaacacaacaugggacaauacucauuaagguugaguacaaaggggaagaugcaccuugcaagauuccuuucuccacggaggauggacaagggaaagcccacaauggcagacugaucacagcuaacccaguggugaccaagaaggaagagccugucaauauugaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuagggaaaauggugcaccaaauauuuggaagugcuuacacggcccuauuuaguggagucuccuggauaaugaaaauuggaauagguguccuuuuaaccuggauaggguugaauucaaaaaacacuucuaugucauuuucaugcauugcgauaggaaucaucacacucuaucugggagccguggugcaagcugacauggggugugucauaaacuggaaaggcaaagaacucaaauguggaaguggaauuuucgucacuaaugagguccacaccuggacagagcaauacaaauuucaagcagacuccccuaaaagacuggcgacagccaucgcaggcgcuugggagaauggagugugcggaaucaggucgacaaccagaauggagaaccucuuguggaagcaaauagccaaugaacugaacuacauauuaugggaaaacaacaucagauuaacgguaguugugggugauacaauuggggucuuacagcaagggaaaagaacacuaccaccacaacccauggagcuaaaauauucauggaaaacauggggaaaggcgaaaauagugacagcuaaaacacaaaauuccuccuucauaauagaugggccaaacacaccagaguggccaagugccucaagagcauggaaugugugggagguggaagauuauggguucggagucuucacaacuaauauaugguugaaacuccgagagauguacacccaacuaugugaccacaggcuaaugucggcagccguuaaggaugagagagccguacacgccgacaugggcuauuggauagaaagccaaaagaauggaaguuggaagcuagaaaaggcaucccuuauagaggugaaaaccugcacauggccaaaaucacacacucucuggagcaauggugugcuagagagcgacaugaucaucccaaagagucuggcagguccuauuucgcaacacaacuacaggcccggauaccacacccaaacggcaggacccuggcaccuaggaaaauuggagcuggacuucaauuauugugaaggaacaacaguugucaucacagaaaauugugggacaagaggcccaucacugaggacaacaacagugucagggaaguugauacacgaaugguguugccgcucguguacacuuccuccccugcgauacaugggagaagacggcugcugguauggcauggaaauuagacccauuaaugagaaagaagagaacaugguaaagucuuuagucucagcagggaguggaaagguggauaacuucacaaugggugucuuguguuuggcaauccucuuugaagaggugaugagaggaaaauucggaaaaaagcacaugauugcagggguccucuucacguuugugcuccuucucucagggcaaauaacauggagagacauggcgcguacacucauaaugauuggguccaacgccucugacagaaugggaaugggcgucacuuaccuagcauugauugcaacauuuaaaauucagccauuuuuggcuuugggauucuuccugaggaaacuaacaucuagagaaaauuuauuguugggaguuggguuggccauggcaacaacguuacaacugccagaggacauugaacaaauggcgaauggaauagcuuuggggcucauggcucuuaaauugguaacacaauuugaaacauaccaacuauggacggcauuagucucccuaauguguucaaacacaauuuucacguugacuguugccuggagaacagccacccugauuuuggccggaauuucgcuuuugccagugugccagucuucgagcaugaggaaaacagauuggcucccaaugacuguggcagcuaugggaguuccaccccuaccacuuuuuaucuucaguuugaaagacacgcucaaaaggagaagcuggccacugaaugagggggugauggccguuggacuugugagcauucuagcaaguucucuccuuaggaaugacguacccauggcuggaccauuaguggcugggggcuugcugauagcgugcuacgucauaacuggcacgucagcagaccucacuguagaaaaagcagcagaugugauaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauacccgcaacacuguuggucuggcacacuuggcaaaagcaaacccaaagauccggcguccuaugggacguacccagccccccagagacacagaaagcagaacuggaagaaggggucuauaggaucaagcagcaaggaauuuuugggaagacccaaguggggguuggaguacaaaaagaaggaguuuuccacaccauguggcacgucacaagaggagcaguguugacacacaaugggaaaagacuggaaccaaacugggcuagcgugaaaaaagaucugaucucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuguauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauuauuagagaggcaaucaagagacgcuuaaggacucuaauuuuggcaccaacaagggugguugcagcugagauggaagaagcauugaaggggcucccaauaagguaucaaacaacugcaacaaaaucugaacacacagggaaagagauuguugaucuaaugugucacgcaacguucacaaugcguuugcugucaccaguuagaguuccaaacuauaacuugauaauaauggaugaggcucauuucacagacccagccaguauagcggcuagaggguacauaucaacucguguaggaaugggagaggcagccgcaauuuucaugacagccacacccccugguacagcugaugccuuuccucagagcaacgcuccaauucaagaugaagaaagagacauaccagaacgcucauggaauucaggcaaugacuggauuaccgacuuugccgggaagacggugugguuugucccuagcaucaaagcuggaaaugacauagcaaacugcuugcggaaaaauggaaaaaaggucauucaacuuaguaggaagacuuuugacacagaauaucaaaggacuaaacuaaaugauugggacuuuguggugacaacagacauuucagaaaugggagccaauuucaaagcagacagagugaucgacccaagaagaugucucaagccagucauuuugacagacggacccgagcgcgugauucuggcgggaccaaugccagucaccguagcgagugcugcgcaaaggagagggagaguuggcaggaacccacaaaaagaaaaugaccaauacauauucacgggccagccccucaauaaugaugaagaccacgcucacuggacagaagcaaaaaugcugcuagacaacaucaacacaccagaagggaucauaccagcucucuuugaaccagaaagggagaagucagccgccauagacggcgaauaccgccugaaaggugaauccaggaagaccuucguggaacucaugaggaggggugaccucccaguuuggcuagcccauaaaguagcaucagaaggaaucaaauauacagacagaaaaugguguuuugauggagaacgcaacaaucaaauuuuagaggagaauauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacacuuagcccacagaacgagaaacgcucuggacaaucuggugauguugcacacgucagaacacggugggagggcuuacaggcaugcaguggaggaauuaccagaaacaauggaaacacucuuacuccugggacucaugauccuguuaacagguggggcaaugcuuuucuugauaucagguaaggggauuggaaagaccucaauaggacucauuugcguaguugcuuccagcgguaugcuauggauggcugaugucccacuccaauggaucgcgucggccauaguccuggaguuuuuuaugauggugcuacuuauaccagaaccagaaaagcagagaacuccccaagacaaucaacuugcauaugucgugauaggcauacuuacauuggcugcaauaguagcagccaaugaaaugggauuguuggaaaccacaaagagagauuuaggaauguccaaagaaccagguguuguuucuccaaccagcuauuuggauguggauuugcacccagcaucagccuggacauuguacgcuguggccacaacgguaauaacaccaauguugagacauaccauagagaauuccacagcaaaugugucccuggcagcuauagccaaccaggcagugguccugauggguuuggacaaaggauggccgauaucgaaaauggacuuaggcguaccacuauuggcacuggguugcuauucacaagugaacccacuaacucucacagcggcaguacuccugcuagucacgcauuaugcuauuauagguccaggauugcaggcaaaagccacucgugaagcucaaaaaaggacagcugcuggaauaaugaagaauccaacgguggaugggauaaugacaauagaccuagauccuguaauauacgauucaaaauuugaaaagcaacuaggacagguuaugcuccugguucugugugcaguucaacuuuuguugaugagaacaucaugggcauuuugcgaagcucuaacccuagccacaggaccaauaacaacacucugggaaggaucaccugggaaguucuggaacaccacgauagcuguuuccauggcgaacaucuuuagagggagcuacuuagcaggagcugggcuugcuuuuuccaucaugaaaucaguuggaacaggaaagagaggaacagggucacaaggugaaaccuugggggaaaaguggaaaaagaaauugaaucaauuaucccggaaagaguuugaccuuuacaagaaauccggaaucacugaaguggauagaacagaagccaaagaaggguugaaaagaggagaaauaacacaccaugccguauccagaggcagcgcaaaacuucaaugguucguggagagaaacauggucaucccugaaggaagagucauagaccugggcuguggaagaggaggcuggucauauuauugugcaggacugaaaaaaguuacagaagugcgaggauacacaaaagguggcccaggacaugaagaaccaguaccuaugucuacauacggauggaacauagucaagcuaaugaguggaaaggauguguuuuaucuuccaccugaaaagugugacacucuauugugugacauuggagaaucuucaccaagcccaacaguggaagaaagcagaaccauaagagucuugaagaugguugaaccauggcuaaaaaauaaccaguuuugcauuaaaguguugaacccuuacaugccaacugugauugagcaccuagaaagacuacaaaggaaacauggaggaaugcuugugagaaauccacucucacgaaacuccacgcacgaaauguacuggauauccaauggcacaggcaacaucgucucuucagucaacaugguauccagacuguuacugaacagauucacaaugacacacaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccacggugacacagauggcaaugacggauacaaccccuuucggccagcaaaggguuuuuaaagagaaaguggacaccaggacaccuagacccaugccaggaacaagaaagguuauggagauuacagcggaauggcuuuggagaacccugggaaggaauaaaagacccagauuaugcacgagagaggaguucacaaaaaagguuagaaccaacgcagcuaugggagccguauucacagaggagaaccaaugggacagugcuagagcugccguugaagaugaagaauucuggaaacuuguggacagagaacgugaacuccacaaacugggcaaguguggaagcugcguuuacaacaugaugggcaagagagagaagaaacucggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagacauuuccaagauacccggaggagccauguaugcugaugacacagcugguugggacacaagaauaacagaagaugaccugcacaaugaggaaaaaaucacacagcagauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggccugaacacauucaccaacauggaagcccaguuaaucagacaaauggaaggagaagguguguugucgaaggcagaccucgagaacccucaucugcuagagaagaaaauuacacaaugguuggaaacuaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucgaagggauggcaugauuggcaacaggucccuuucugcucccaccacuuucaugaauugaucaugaaagauggaagaaaguugguaguccccugcagaccucaggaugaauuaauagggagagcgagaaucucucaaggggcaggauggagccuuaaagaaacugcaugccuagggaaagccuacgcccaaaugugggcucucauguauuuucacagaagagaucuuagacuagcauccaaugccauauguucagcaguaccaguccauuggguccccacaagcaggacgacgugguccauucaugcucaccaucaguggaugacuacagaggacaugcuuacuguuuggaacaggguguggauagaggauaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugcccucgaugaagagauucaggaaggaggaggagucagagggagccauuugguaa

SEQ ID NO: 7762 - RNA, 9873 nt, Artificial Sequence
  derived and/or modified CDS sequence (wt) from DENV-3__AY858039__SS-prME
acaucgcucugucucaugaugauguuaccagcaacacuugcuuuccacuugacuucacgagauggagagccgcgcaugauuguggggaagaaugaaagaggaaaaucccuacuuuuuaagacagccucuggaaucaacaugugcacacucauagccauggauuugggagaaaugugugaugacacggucacuuacaaaugcccccucauuacugaaguggagccugaagacauugacugcuggugcaaccucacaucgacgugggugaccuacggaacgugcaaccaagcuggagagcauagacgcgauaagagaucgguggcguuagcuccucaugucggcaugggacuggacacacgcgcccaaaccuggaugucggcugaaggagcuuggagacaagucgagaagguagagacaugggccuuuaggcacccaggguucacaauacuagcccuauuucuugcccauuacauaggcacuuccuugacccagaaaguggucauuuucauacuacuaaugcuggucaccccauccaugacaaugagaugugugggaguaggaaacagagauuuuguggaaggccuaucaggagcuacguggguugacguggugcucgaacacggugggugugugacuaccauggcuaagaacaagcccacgcuggacauagagcuccagaagaccgaggccacccaacuggcaacccuaaggaaacuaugcauugagggaaaaaucaccaacgugacaaccgacucaaggugccccacccaaggggaagcgauucuaccugaggagcaggaccagaacuacguguguaagcacacauacguggacagaggcuggggaaacgguugugguuuguuuggcaagggaagcuugguaacaugcgcgaaauuucaauguuuggaauuaauagagggaaaaguggugcagcaugagaaccucaaauacaccgucaucaucacagugcacacaggagaccaacaccaggugggaaaugaaacgcagggagucacggcugagauaacaccccaggcaucaaccgucgaagccaucuuaccugaauauggaacccuugggcuagaaugcucaccacggacagguuuggauuucaaugaaaugauuuuguugacaaugaagaauaaagcauggaugguacauagacaaugguuuuuugacuuaccucuaccauggacaucaggggcuacaacagaaacaccaaccuggaauaagaaagagcuucuugugacauucaaaaaugcacacgcaaaaaaacaagaaguaguaguccuuggaucgcaagagggagcaaugcacacagcacugacaggagcuacagagauccaaaccucaggaggcacaaguauuuuugcggggcacuugaaaugcagacucaagauggacaaauuggaacuuaaggggaugagcuaugcaaugugcucaaaugccuuuguguugaagaaagaagucucugaaacacaacaugggacaauacucauuaaggucgaguacaaaggggaagacgcaccuugcaagauuccuuucuccacggaggauggacaagggaaagcccacaauggcagacugaucacagcuaacccaguggugaccaagaaggaggagccugucaauauugaggcagaaccuccuuuuggggaaaguaacauaauaauuggaauuggagacaaagccuugaaaaucaauugguacaagaagggaagcucgauugggaagauguucgaggccacugccagaggugcaaggcgcauggccaucuugggagacacagccugggacuuuggaucaguaggugguguuuuaaauucacuagggaaaauggugcaccaaauauuuggaagugcuuacacggcccuuuuuaguggagucuccuggauaaugaaaauuggaauagguguccucuuaacuuggauaggguugaauucaaaaaacacuucuaugucauuuucaugcauugugauaggaaucaucacacucuaucugggagccguggugcaagcugacauggggugugucauaaacuggaaaggcaaagaacucaaauguggaaguggaauuuucguuacuaaugagguccacaccuggacagagcaauacaaauuucaagcagacucccccaaaagacuggcgacagccauugcaggcgccugggagaauggaguguguggaaucaggucgacaaccagaauggagaaccucuuguggaagcaaauagccaaugaacuaaacuacauauuaugggaaaacaacaucaaauuaacgguaguugugggugauauaauuggggucuuagagcaagggaaaagaacacuaacaccacaacccauggagcuaaaauauucauggaaaacauggggaaaggcgaaaauagugacagcugaaauacaaaauuccuccuuuauaauagaugggccaaacacaccagaguguccaaaugccucaagagcauggaaugugugggagguggaagauuacggguucggagucuucacaacuaauauauggcugaaacuccgagagauguacacccaacuaugugaccacaggcuaaugucggcagccguuaaggaugagagagccguacacgccgacaugggcuauuggauagaaagccaaaagaaugguaguuggaagcuagaaaaggcaucucucauagaggugaaaaccugcacauggccaaaaucacacacucucuggagcaaugguguguuggagagugacaugaucaucccaaagagucuggcugguccuaucucgcaacacaacuacaggcccggauaccacacccaaacggcaggacccuggcaccuaggaaaauuggagcuggacuucaacuauugugaaggaacaacaguugucaucacagaaaauugugggacaagaggcccaucacugaggacaacaacagugucagggaaauugauacacgaaugguguugccgcucguguacacuuccuccccugcgauauaugggagaagacggcugcugguauggcauggaaauuagacccauuaaugagaaagaagagaacaugguaaagucuuuagucucagcagggaguggaaagguagauaacuucacaaugggugucuugugucuugcaauccucuuugaagagguaaugagaggaaaauucgggaaaaagcacaugauugcagggguucucuucauauuugugcuccuucucucagggcaaauaacauggagagacauggcgcgcacacucauaaugauuggauccaacgccucugacagaaugggaaugggcgucacuuaccuagcauugauugcaacauuuaaaauucagccauuuuuggcuuugggauucuuccugaggaaacugacaucuagagaaaauuuauuauugggaguuggguuggccauggcaacaacguugcaacugccagaggacauugaacaaauggcgaauggaauagcccuggggcucauggcucuuaaauugauaacacaauuugaaacauaccaacuauggacggcauuagucucccuaacguguucaaacacaauuuucacguugacuguugccuggagaacagccacccugauuuuggccggaauuucgcuuuugccagugugccagucuucgagcaugaggaaaacagauuggcucccaaugacuguggcagcuaugggaguuccaccuucaccacuuuuuauuuucaguuugaaagacacacucaaaaggagaagcuggccacugaaugagggggugauggccguuggacuugugagcauucuagcaaguucucuccuuaggaaugacguacccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacaucuuaacagugcuuuugaaaacagcauuacuaauagugucaggcauuuuuccauacuccauaccugcaacacuuuuggucuggcacacuuggcaaaagcaaacccaaagauccggcguccugugggacgugcccagccccccagagacacagaaagcagaacuggaagaaggggucuauaggaucaagcagcgaggaauuuuuggaaagacccaaguggggguuggaguacaaaaagaaggaguuuuccacacuauguggcacgucacaagaggagcaguguugacauacaauggaaaaagacuggaaccaaacugggcuagcgugaaaaaagaucugauuucauacggaggaggauggagacugagugcacaauggcaaaaaggagaagaggugcagguuauugccguagagccugggaagaacccaaagaacuuucaaaccaugccaggcauuuuccagacaacaacaggggagauaggagcgauugcacuggacuucaagccuggaacuucaggaucucccaucauaaacagagagggaaagguagugggacuauauggcaauggaguggucacaaagaaugguggcuaugucaguggaauagcucaaacaaacgcagaaccagacggaccgacaccagaguuggaagaagagauguucaaaaagcgaaaucuaaccauaauggaucuccaucccgggucaggaaagacgcggaaauaccuuccagcuauaguuagagaggcaaucaagagacgcuuaaggacucuaauucuggcaccaacaagggugguugcagcugagauggaagaagcauugaaagggcucccaauaagguaucaaacaacugcaacaaaaucugaacacacagggaaagagauuguugaucuaaugugucacgcaacguucacaaugcguuugcugucaccagucagaguuccaaacuacaacuugauaauaauggaugaggcucauuucacagacccagccaguauagcggcuagaggguacauaucaacucguguaggaaugggagaggcagccgcaauuuucaugacagccacaccuccuggaacagcugaugccuuuccucagagcaaugcuccaauucaagaugaagaaagagacauaccagaacgcucauggaauucaggcaaugauuggauuaccgacuuugccggaaagacugugugguuuguccccagcaucaaagcuggaaaugacauagcaaacugcuugcggaaaaauggaaaaaagguuauucaacuuaguaggaaaacuuuugacacagaauaucaaaagacuaaacuaaaugauugggacuuuguggugacaacagacauuucagaaaugggagccaauuucaaagcagacagaguuaucgacccaagaagaugucucaagccagucauuuugacagacggacccgagcgcgugauccuggcgggaccaaugccagucaccguagcgagugcugcgcaaaggagagggagaguuggcaggaacccacaaaaagaaaaugaccaauacauauucacgggccagccccucaacaaugaugaagaccacgcucacuggacagaagcaaaaaugcugcuagacaacaucaacacaccagaaggaaucauaccagcucucuuugaaccagaaagggagaagucagccgccauagacggcgaauaccgccugaaaggugaguccaggaagaccuucguggaacucaugaggaggggugaccucccaguuuggcuagcccauaaaguagcaucagaaggaaucaaauacacagacagaaaaugguguuuugauggagagcgcaacaaucaaauuuuagaggagaauauggauguggaaaucuggacaaaggaaggagaaaagaaaaaauugaggccuagguggcuugaugcccgcacuuauucagaucccuuagcgcucaaggaauucaaggacuuugcggcugguagaaagucgaucgcccuugaucuugugacagaaauaggaagagugccuucacauuuagcccacagaacgagaaacgcucuggacaaucuggugauguugcacacgucagaacacggugggagggccuacaggcaugcaguggaggaauuaccagaaacaauggaaacacucuuacuccugggacucaugauccuguugacagguggggcgaugcuuuucuugauaucaggcaaagggguuggaaagacuucaauaggacucauuuguguaguugcuuccagcggcauguuauggauggcugauaucccacuccaauggaucgcgucggccauaguucuggaguuuuuuaugauggugcuacuuauaccagaaccagaaaagcagagaacuccccaagacaaucaacucgcauaugucgugauaggcauacuuacauuggcugcaauaguagcagccaaugaaaugggauuguuggaaaccacaaagagagauuuagggauguccaaagaaccagguguuguuucgccaaccagcuauuuggauguggauuugcacccagcaucagccuggacauuguaugcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcgugccacuauuggcacuggguugcuauucacaagugaacccacuaacucucacagcggcaguacuccugcuagucacgcauuaugcuauuauagguccaggauugcaggcaaaagccacucgugaagcucaaaaaaggacggcugcuggaauaaugaagaauccaacgguggaugggauaaugacaauagaccuagauccuguaauauacgauucaaaauuugaaaaacaacuaggacaaguuaugcuccugguucugugugcaguucaacuuuuguuaaugagaacaucaugggcauuuugugaagcucuaacccuagccacaggcccaauaacaacacucugggaaggaucaccugggaaguucuggaacaccacgauagcuguuuccauggcgaacaucuuuagagggaguuauuuagcaggagcugggcuugcuuuuucuaucaugaaaucaguuggaacaggaaagagaggaacagggucacaaggugaaacuuugggagaaaaguggaaaaagaaauugaaucaauuaucccggaaagaguuugaccucuacaagaaauccggaaucacugaaguggauagaacagaagccaaagaaggguugaaaagaggagaaauaacacaccaugccguauccagaggcagcgcaaaacuucaaugguucguggagagaaacauggucauuccugaagggagagucauagacuugggcuguggaagaggaggcuggucauauuauugugcaggauugaaaaaaguuacagaagugcgaggguacacaaaaggcggcccaggacaugaagaaccaguaccuaugucuacguauggauggaacauagucaagcugaugaguggaaaggauguguuuuaucuuccaccugaaaagugugacacucuauugugugacauuggagaaucuucaccaagcccaacaguggaagagagcagaaccauaagagucuugaaaaugguugaaccauggcuaaaaaauaaccaguuuugcaucaaaguauugaacccuuacaugccaacugugauugagcaccuagaaagacuacaaaggaaacauggaggaaugcuugugagaaauccacuuucacgaaacuccacgcacgaaauguacuggauaucuaauggcacaggcaacaucgucucuucagugaacaugguauccagacugcuacugaacagauucacaaugacauauaggagacccaccauagaaaaagauguggauuuaggagcggggacccgacaugucaacgcggaaccagaaacacccaacauggaugucauuggggaaagaauaagaaggaucaaggaggagcauaguucaacauggcacuaugaugaugaaaauccuuacaaaacgugggcuuaccauggaucuuaugaaguuaaggccacaggcucagccuccuccaugauaaauggagucgugaaacuccucacgaaaccaugggauguggugcccacggugacacagauggcaaugacggacacaaccccuuuuggccagcaaaggguuuuuaaagagaaaguggacaccaggacacccaaacccaugccaggaacaagaaaggucauggagaucacagcggaauggcuuuggagaacccugggaaggaacaaaagacccagauuaugcacaagagaggaguucacaaaaaaggucagaaccaacgcagcuaugggcgccguauucacagaggagaaccaaugggacagugcuagagcugccguugaagaugaagaauucuggaaacucguggacagagaacgugaacuccacaaauugggcaaguguggaagcugcguuuauaacaugaugggcaagagagagaagaaacuuggagaguuuggcaaagcaaaaggcaguagagccauaugguacaugugguugggagccagguaccuugaguucgaggcacucggauucuuaaaugaagaccauugguucucgcgugaaaacucuuacaguggaguagaaggggaaggacugcauaagcugggauacaucuugagagauauuuccaagauacccggaggagcuauguaugcugaugauacagcugggugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagaggcaguggacaggugggaacuuauggucugaauacauucaccaacauggaagcccaguugaucagacaaauggaaggagaagguguguugucgaagacagaccucgagaacccucaucugcuagagaagaaaauuacacaaugguuggaaaccaaaggaguggagagguuaaaaagaauggccaucagcggggaugauugcguggugaaaccaaucgacgacagguucgccaaugcccugcuugcccugaaugacaugggaaaaguuaggaaggacauaccccaauggcagccaucgaagggauggcaugauuggcaacaagucccuuucugcucccaccacuuucaugaauuaauuaugaaagauggaagaaaguugguaguccccugcagaccucaggaugaauuaauagggagagcgagaaucucucagggagcaggauggagccuuaaagaaacugcaugccuagggaaagccuacgcccaaaugugggcucucauguauuuucacagaagagaucuuagacuagcauccaacgccauauguucagcaguaccaguccauuggguccccacaagcagaacgacgugguccauccaugcucaccaccaguggaugacuacagaagacaugcuuacuguuuggaacaggguguggauagaggacaauccauggauggaagacaaaacuccagucacaacuugggaagauguuccauaucuagggaagagagaagaccaauggugcggaucacucauuggucucacuuccagagcaaccugggcccagaacauacuuaccgcaauccaacagguaagaagccuuauaggcaaugaagaguuucuggacuacaugccuucgaugaagagauucaggaaggaggaggagucagagggagccauuugguaa

SEQ ID NO: 7763 - RNA, 9873 nt, Artificial Sequence
  derived and/or modified CDS sequence (wt) from DENV-3__JN368477__SS-prME
acaucgcucugucucaugaugauguuaccagcaacacuugcuuuccacuugacuucacgcgauggagagccgcgcaugauuguggggaagaaugaaagagggaaauccuuacuuuuuaagacagcuucuggaaucaacaugugcacucucauagcuauggacuugggagagaugugugaugacacggucacuuauaaaugcccccucauugcugaaguggaaccugaagacauugacugcuggugcaaccucacaucgacaugggugacuuauggaacgugcaaucaagcuggggagcauagacgugacaagagaucaguggcguuagcuccccauguuggcaugggacuggacacacguacccaaaccuggaugucggcugaaggagcuuggagacaaguugaaaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagagcaagccuacgcuggacauagagcuucagaagaccgaggccacccaacuggcgacccuaaggaaguuaugcauugagggaaaaauuaccaacauaacaacugacucaagguguccuacccaaggggaagcgacucuaccugaggagcaggaccagaacuacguauguaagcacacauacguggauagagguuggggaaacgguugugguuuguuuggaaaaggaagcuuggugacaugcgcgaaauuucagugucuagaaccaauagagggaaaaguggugcaauaugaaaaccuuaaauacacugucaucaucacagugcacacaggagaccaacaccaggugggaaaugacacgcagggagucacaguugagauaacaccccaggcaucaaccguugaagcugucuugccugaguauggaacccuuggacuagaaugcucaccacggacaggccuggauuucaaugaaaugauuuuauugacaaugaaaaacaaagccuggaugguacauaggcaaugguucuuugaccuaccccuaccauggacaucaggagcuacaacagagacaccaacuuggaacaggaaagagcuucuuguaacauucaaaaaugcucaugcaaaaaagcaagaagugguuguccuuggaucgcaagagggagcaaugcacacagcgcugacaggagcuacagagauucaaaacucaggagguacaagcauuuuugcggggcauuugaaauguagacucaagauggacaaacuggaacucaaggggaugagcuaugcaaugugcuugaauaccuuuguguugaagaaagaagucuccgaaacgcagcaugggacaauacucauuaagguugaguacaaaggggaagaugcaccuugcaaaauuccuuucuccacagaggauggacaagggaaagcccacaaugguagauugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuaucacacucuaucugggagccgugguacaagcugacauggggugcgucauaaacuggaaaggaaaagaacucaaauguggaaauggaauuuuugucacuaaugagguccacacuuggacagagcaauacaaauuucaagcagacucccccaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguaccuggccaaaaucacacacucuuuggagcaaugguguacuagagagugacaugaucaucccaaagagucuagcugguccuauuucacaacacaaccauaggcccggguaccacacccaaacggcaggaccuuggcacuugggaaaauuggagcuggacuuuaacuauugugaaggaacaacaguagucaucgcagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaagucuuuagucucagcagggaguggaaagguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuuccgacaggaugggaaugggcguuacccauuuagcuuuaauugcaacauucaaaauucagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacuaauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggagucccacccuuaccacuuuuuaucuuuagcuugaaggacacacccaaaaggaggagcuggccacugaaugagggagugauggcuguugggcuugugagcauccuagcuaguucucuccuuaggaaugaugugcccauggcuggaccacuaguggccgggggcuuguugauagcgugcuaugucauaacuggcacgucagcagaccucacuguagaaaaggcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguuucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccagguggggguuggagugcagaaagaaggaguuuuccauaccauguggcacgucacaagaggggcaguauugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaacuauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacauucacaaugcgcuuacuaucaccagucaggguuccaaauuacaauuugguaauaauggaugaggcccauuucacagacccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuucguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaaucuugacagauggacccgagcgagugauccuggcuggaccaaugccaguuaccgcagcgagcgcugcgcaaaggagagggagaguuggcaggaacccacaaaaggaaaaugaccaguacauauucacgggccagccucucaacaaugacgaagaccaugcccacuggacagaagcaaaaaugcugcuagacaacauuaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuggaggagaacauggauguggaaaucuggacaaaggaaggagaaaggaaaaaacugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaacuuggugaugcugcacacgucagaacauggcgguagggcuuacaggcaugcaguagaggaacuaccagaaacaauggaaacacuccuacucuugggacucaugaucuuauuaacagguggagcaaugcuuuucuugauaucagguaaagggauuggaaagacuucaauaggacuuauuugugucauuguuuccaguggcauguuauggauggcugaugucccacuucaauggaucgcgucagcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaauguuucccuggcagccauagcuaaccaggcagugguccugauggguuuagacaaaggauggccaauaucgaaaauggaccuaggcguaccgcuauuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggacgggauaaugacaauagaccuagauccuguaauauacgauucaaaauucgaaaagcaacuaggacaggucaugcucuugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggccaacaucuuuagagggagcuacuuagcaggagcugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaggaaggguugaaaagaggagaaacaacacaucaugcuguguccagaggcagcgcaaaacuucaaugguucguggagaggaacauggucauucccgaaggaagagucauagaccuaggcuguggaagaggaggcuggucauauuauugcgcaggacugaaaaaaguuacagaagugcgaggauacacaaaaggcggcccaggacacgaagaaccaguaccuaugucuacauacggauggaacauagucaaguuaaugaguggaaaggacguguucuaucuuccaccugaaaagugugacacccuauugugugacauuggagaaucuucaccaagcccaacaguggaagaaagcagaacuauaagaguuuugaagaugguugagccaugguuaagaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagcgcgagagcugcuguugaggacgaggaauucuggaaacuuguggacaaagaacgugaacuccacaaauugggcaaguguggaagcugcgucuacaacaugaugggcaagagagagaagaaacuuggagaguuuggcaaagcaaaaggcaguagagccauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugccgaugacacagcuggcugggacacaagaauaacagaagaugaccugcacaaugaggaaaaaaucacacagcaaauggacccuggacacagacaauuagcgaacgccauauuuaagcucacauaucaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccccaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaaucucucaaggagcaggauggagccuuaaagaaacugcaugucuagggaaagcuuacgcucaaauguggagucucauguauuuucacagaagagaucuuagacuagcauccaacgccauuuguucagcaguaccaguccauuggaucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggugaugaagaauuucuggacuacaugccuucgaugaagagauucaggaaggaggaggagacagagggagccauuugguaa

SEQ ID NO: 7764 - RNA, 9873 nt, Artificial Sequence
  derived and/or modified CDS sequence (wt) from DENV-3__EF643017__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggacuugggagagaugugugaugacacggucacuuacaaaugcccccacauuaccgaaguggaaccugaagacauugacugcuggugcaaccuuacaucaacaugggugacuuacggaacgugcaaucaagccggagagcguagacgcgacaagagaucaguggcguuagcuccccaugucggcaugggacuagacacacgcacccaaaccuggaugucggcugaaggagcuuggaggcaagucgagaagguagagacaugggcccuuaggcacccaggguucaccauacuagcccuauuucuugcccauuacauaggcacauccuugacccagaaggugguuauuuuuauacuacuaaugcuggucaccccauccaugacaaugagaugugugggaguaggaaacagagauuuuguggaaggucuaucaggagcuacguggguugacguggugcucgagcacggggggugugugacuaccauggcuaagaacaagccaacguuggauauagagcuucagaagaccgaggccacccaauuggcgacccuaaggaagcuaugcauugaggggaaaauuaccaacauaacaacugacucaagauguccuacccaaggggaagcgguuuugccugaggagcaggaccagaacuacguguguaagcauacauacguagacagaggcugggggaacggaugugguuuguuuggcaagggaagcuugguaacaugugcgaaauuucaaugcuuggaaccaauagagggaaaaguggugcaguaugagaaccucaaauacaccgucaucaucacagugcacacaggagaucaacaccaggugggaaaugaaacgcagggagucacggcugagauaacaccccaggcaucaaccacugaagccaucuugccugaauauggaacccuugggcuagaaugcucaccacggacagguuuggauuucaaugaaaugaucuugcuaacaaugaagaacaaagcauggaugguacauagacaaugguuuuuugaccuaccucuaccauggacaucaggagcuacaacggaaacaccaaccuggaacaggaaggagcuucuugugacauuuaaaaacgcacaugcgaagaaacaagaagugguuguccuuggaucgcaagagggagcaaugcauaccgcauugacaggagccacagaaauccaaaacucaggaggcacaaguauuuuuucagggcauuuaaaauguagacuuaagauggacaaauuggaacucaaggggaugagcuaugcaaugugcacgaauaccuuuguguugaagaaagaagucucagaaacgcagcaugggacaauacucauuaaggucgaguacagaggggaagaugcaccuugcaagauuccuuucuccacagaggauggacaagggaaagcucacaauggcagacugauuacagccaacccaguggugacuaagaaggaggagccugucaauaucgaggcugaaccuccuuuuggggaaaguaauauagugauuggaauuggagacaacgccuugaaaaucaacugguauaagaaaggaagcucuauugggaagauguucgaggccacugccagaggugcaaggcgcauggccaucuugggagacacagcuugggacuuuggaucagugggugguguucugaacucauuaggcaaaauggugcaccaaauauucggaagugcuuacacagcccuauucaguggagucucuuggguaaugaaaaucggaauaggaguucucuugacuuggauaggguugaauucaaaaaacacauccaugucauuuucaugcauugcgauaggaaucauuacacucuaucugggagcuguggugcaagcugacaugggauguguuauaaacuggaaaggcaaagaacucaaauguggaaguggaaucuucgucaccaacgagguccauaccuggacagagcaauacaaauuccaagcagacuccccaaaaagauuggcgacagccauugcaggcgcuugggagaauggagugugcggaauuaggucaacaaccagaauggagaaucuccuguggaagcaaauagccaaugaacugaacuacauauugugggaaaacaauaucaaauuaacgguaguugugggcgauauaauuggggucuuagagcaaggaaaaagaacacuaacaccacaacccauggagcuaaaauacucauggaaaacguggggaaaggcaaaaauagugacagcugaaacacaaaauuccucuuucauaauagacgggccgaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccguacaugccgacaugggcuauuggauagaaagccaaaagaauggaaguuggaagcuagaaaaagcaucccucauagaggugaaaaccugcacauggccaaaaucacauacccuuuggaguaauggugugcuagagagugauaugaucaccccaaagagucuagcugguccuauuucgcaacacaaccacaggcccggguaccacacccagacggcgggacccuggcauuuaggaaaauuagagcuggacuucaacuauugugaaggaacaacaguugucaucacagaaaacugugggacaagaggcccaucauugagaacaacaacagugucagggaaguuaauacacgaaugguguugccguucgugcacacuuccuccccugcgauacaugggagaagacgguugcugguauggcauggaaauuagacccaucagugagaaagaagagaacaugguaaagucuuuagucucagcgggaaguggaaagguggacaacuucacaaugggugucuuguguuuggcaauccucuuugaagaggugaugagaggaaaauuugggaagaaacacaugauugcggggguguucuucacguuugugcuccuucucucagggcaaauaacauggagagacaugacgcacacacuaauaaugauuggguccaacgcaucugacaggaugggaaugggcguuaccuaccuagcuuuaauugcaacauuuaaaauccagccauucuuggcuuugggauuuuuccuaagaaaacugacauccagagaaaauuuauuguuaggaguugggcuggcuauggcaacaacguuacaacugccagaggacauugaacaaauggcaaauggaaucgcucuggggcucauggcucuuaaacugauaacacaauuugaaacauaccaauuauggacagcauugaucuccuuaacguguucaaauacaauguuuacguugacuguugccuggagaacagccacccugauuuuggccggaguuucgcuuuuaccagugugccagucuucgagcaugaggaaaacagacuggcuuccaauggcaguggcagcuaugggaguuucaccucuaccacuuuuuauuuuuagcuugaaagacacacucaaaaggagaagcuggccacugaaugaaggggugauggcuguugggcuugugagcauucuggccaguucucuccuuagaaaugauguacccauggcuggaccauugguggccgggggcuugcugauagcgugcuacgucauaacuggcacgucagcagaccucaccguagaaaaagcagcagauauaacacgggaggaagaggcugagcaaacaggagugucccacaacuuaaugaccacaguugaugaugauggaacaaugagaauaaaagaugaugagacugagaauauccuaacagugcuuuugaaaacagcauuacuaauaguaucaggagucuuuccauacuccauacccgcaacauugcuggucuggcauacuuggcaaaagcaaacccaaagauccggcguucuaugggacguacccagccccccagagacacagaaagcagaacuggaagaaggggucuauaggaucaaacagcaaggaauuuuugggaaaacccaaguagggguuggaguacagaaagaaggagucuuccacaccauguggcacguuacaagaggggcaguguugacauauaaugggaaaagacuggaaccaaacugggcuagcgugaaaaaagaucugauuucauacggaggaggauggagauugagcgcacaauggcaaaagggggaggaggugcagguuauugccguagagccugggaagaacccaaagaacuuucaaaccaugccaggcacuuuucagacuacaacaggggaaauaggagcaauugcacuggauuucaagccuggaacuucaggaucucccaucauaaacagagagggaaagguagugggacuguauggcaauggagugguuacaaagaaugguggcuacgucagcggaauagcgcaaacgaaugcagaaccagauggaccaacaccagaauuggaagaagagauguucaaaaagcgaaaucuaaccauaauggaucuucauccugggucaggaaagacacggaaauaccuuccagcuauuguuagagaggcaaucaagagacguuuaagaacucuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcgucugcugucaccaguuaggguuccaaacuauaacuugauaauaauggaugaagcccauuucacagacccagccaguauagcggcuagaggguacauaucgacucguguuggaaugggagaggcagccgcaauuuucaugacagcaacgcccccuggaacagcugaugccuuuccucagagcaacgcuccaauucaagaugaagaaagggacauaccagaacgcucauggaauucaggcaaugaauggauaaccgacuucgcugggaaaacggugugguuuguccccagcauuaaagccggaaaugacauagcaaacugcuugcgaaaaaacgggaaaaaggucauucaacuuaguaggaagacuuuugacacagaauaucagaaaacuaaacugaaugauugggacuucguggugacaacugacauuucagaaaugggggccaauuucaaagcagauagagugaucgacccaagaagaugucucaaaccagugauccugacagauggaccagagcgggugauccuggcuggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacauuaauacgccagaagggaucauaccagcucucuuugagccagaaagggagaagucagccgccauagacggugaguaucgcuugaaaggugaguccaggaagacuuucguggaacucaugaggaggggugaccuuccagucugguuagcccauaaaguagcaucagaagggaucaaauauacagauagaaaauggugcuuugauggacaacguaauaaucaaauuuuagaggagaacauggauguggaaaucuggacuaaggaaggagaaaagaaaaaauugagaccuagguggcuugaugcccgcacuuauucagaucccuuagcacucaaggaauucaaggacuuugcggcuggcagaaagucaaucgcccuugaucuugugacagaaauaggaagagugccuucacaccuagcccauagaacgagaaacgcucuggacaaucuggugaugcugcacacgucagaacauggcgguagggccuacaggcaugcgguggaggaacuaccagagacaauggaaacacuccuacucuugggacucaugaucuuguugacagguggagcaaugcuuuucuuaauaucagguaaagggauuggaaagacuucaauaggacucauuuguguaauugcuuccagcggcaugucguggauggccgaaaucccacuccaauggaucgcgucggcuauaguccuggaguuuuuuaugaugguguugcuuauaccagaaccagaaaagcagagaaccccccaagacaaccaacuugcauaugucgugauaggcauacuuacauuggcugcaauaauagcagcuaaugaaaugggauuguuggaaacuacaaagagagauuuaggaaugucuaaggagccagguguugucucuccaaccagcuauuuagauguggacuugcacccagcaucagccuggacauuguaugccguggccacuacaguaauaacaccaauguuaagacauaccauagagaauucuacagcaaaugugucucuggcagcuauagccaaccaggcagugguccugauggguuuggacaaaggauggccaauaucaaaaauggacuuaggagugccccuacuggcauugggcugcuauucacaagugaacccacugacucuaacagcggcaguacucuugcugaucacacauuaugcuaucauagguccaggauugcaggcaaaagccacucgugaagcucagaaaaggacagcugcuggaauaaugaagaauccaacaguggaugggauaaugacaauagaccuagauccuguaauauaugauucaaaauuugaaaagcaacugggacagguuaugcuccugguuuugugugcaguucaacuuuuguuaaugagaacaucaugggccuugugugaagcuuuaacucuagcuacaggaccaauaacaacacucugggaaggaucaccugggaaguuuuggaacaccacgauagcuguuuccauggcgaacauuuuuagagggaguuauuuagcaggaguugggcuugcuuuuucuauuaugaaaucaguuggaacaggaaaaagaggaacaggcucacaaggugaaacuuuaggagaaaaauggaaaaagaaauuaaaucaauuaucccggaaagaguuugaucuuuacaagaaaucuggaaucacugaaguggauagaacagaagccaaagaaggguugaaaagaggagaaauaacacaucaugccguguccagagguagcgcaaaacuucaaugguuuguggagagaaacauggucauucccgaaggaagagucauagacuugggcuguggaagaggaggcuggucauauuacugugcaggacugaaaaaagucacagaagugcgaggauacacaaaaggcgguccaggacacgaagaaccaguaccuauguccacauauggauggaacauaguuaaguuaaugaguggaaaggauguguuuuaucuuccaccugaaaagugugacacccuguugugugacauuggagaaucuucaccaagcccaacaguggaagaaagcagaacuauaagaguuuugaagaugguugaaccauggcuaaaaaacaaccaauuuugcauuaaaguauugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucgcuucagucaauaugguaucuagacugcuacugaacagguucacgaugacacacagaagacccaccauugagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggaucuuaugaagucaaagccacaggcucagccuccuccaugauaaauggagucgugaaacuccucacuaaaccaugggauguggugcccauggugacacagauggcaaugacagauacaacuccauuuggccagcagagaguuuuuaaagagaaaguggacaccaggacacccagguccaugccaggaacaagaagggucauggggaucacagcggaguggcucuggagaacccugggaaggaacaaaaaacccagguuaugcacaagggaagaguucacaaaaaaggucagaacuaacgcagccaugggcgccguuuucacagaggagaaccaaugggacagcgcgaaagcugcuguugaggaugaagauuuuuggaaacuuguggacagagaacgugaacuccacaaacugggcaaguguggaagcuguguuuacaacaugaugggcaagagagagaagaaacuuggagaguuuggcaaagcaaaaggcaguagagcuauaugguacaugugguugggagccagguaccuugaguucgaagcccuuggauucuuaaaugaagaccacugguucucgcgugagaacucuuacaguggaguggaaggagaaggacugcacaagcuaggcuauauauuaagggacauuuccaagauacccggaggagcuauguaugcugaugacacagcugguugggacacaagaauaacagaagaugaccugcacaaugaggaaaagaucacacagcaaauggacccugaacacaggcaguuagcgaacgcuauauuuaagcucacauaccaaaacaaaguggucaaaguucaacgaccgacuccaacaggcacgguaauggacaucauaucuaggaaagaccaaagaggcaguggacagguaggaacuuauggucugaauacauucaccaacauggaagcccaguuaaucagacaaauggaaggagaaggugugcugucaaaggcagaccucgagaacccucaucugccagagaagaaaauuacacaaugguuggaaaccaaaggaguggagagguuaaaaagaauggccauuagcggggaugacugcguagugaaaccaaucgaugacagguuugcuaaugcccugcucgcucugaacgauacgggaaagguucggaaagacauaccucaauggcagccaucaaaaggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaaccgcaugucuggggaaagccuacgcucaaauguggagucucauguauuuucacagaagagaccucagacuagcauccaacgccauauguucagcaguaccaguccacuggguccccacaaguagaacgacauggucuauucaugcucaccaucaguggaugaccacagaagacaugcuuacugucuggaacaggguguggaucgaggacaauccauggauggaagacaaaacuccagucacaaccugggaaaauguuccauaucuagggaagagagaagaccaauggugcggaucacuuauuggucucacuuccagagcaaccugggcccagaacauacccacagcaauucaacaggugagaagccuuauaggcaaugaagaguuucuggacuacaugccuucaaugaagagauuuaggaaggaggaggagucggagggagccauuugguaa

SEQ ID NO: 7765 - RNA, 9873 nt, Artificial Sequence
  derived and/or modified CDS sequence (wt) from DENV-3__DQ675519__SS-prME
acaucgaucugucucaugaugauguuaccagcaacacuugccuuccacuugacuucacgagauggagagccgcgcaugauuguggggaagaaugaaagaggaaaaucccuacuuuucaagacagccucuggaauuaacaugugcacacuuauagccauggauuugggagagaugugugaugacacggucacuuacaaaugcccccucauuacugaaguggagccugaagacauugacugcuggugcaaccuuacaucgacaugggugaccuacggaacguguaaucaagcuggagagcauagacgcgauaagagaucgguggcgcuagcuccccaugucggcaugggacuggacacacgcacccaaaccuggaugucggcugaaggagcuuggagacaagucgagaagguagagacaugggccuuuaggcacccaggguucacaauauuagcccuauuucuugcccauuacauaggcacuuccuugacccagaaaguggucaucuucauauuacuaaugcuggucaccccauccaugacaaugaggugugugggaguaggaaacagagauuuuguggaaggccuaucaggagcuacguggguugacguggugcucgagcacggagggugugugaccaccauggcuaagaacaagcccacgcuggauauagagcuccagaagaccgaggccacccaacuggcgacccuaagaaaacuaugcauugagggaaaaauuaccaacguaacaaccgacucaaggugccccacccaaggggaagcgauuuuaccugaggagcaggaccaaaacuacguguguaagcacacauacguggacagaggcuggggaaacgguugugguuuguuuggcaagggaagcuugguaacaugcgcgaaauuucaauguuuggaaucaauagagggaaaaguggugcagcaugagaaccucaaauacaccguuaucaucacagugcacacaggagaccaacaccaggugggaaaugaaacgcagggggucacggcugagauaacaccacaggcaucaaccguugaagccaucuuaccugaauauggaacccuuggguuagaaugcucaccacggacagguuuagauuucaaugaaaugaucuuguugacaaugaagaacaaagcauggaugguacauagacaaugguuuuuugaccuaccuuuaccauggacaucaggggcuacaacagaaacaccaaccuggaacaagaaagagcuucuugugacauucaagaacgcacaugcaaaaaaacaagaaguagugguccuuggaucgcaagagggagcaaugcacacagcacugacaggagccacagagauccaaaccucaggaggcacaagcaucuuugcggggcacuuaaaaugcagacucaagauggacaaauuggaacucaaggggaugagcuaugcaaugugcuugaaugccuuuguguugaagaaagaagucuccgaaacgcaacaugggacaauacucauuaagguugaguacaaaggggaagaugcacccugcaggauuccuuucuccacggaggauggacaagggaaagcucacaauggcagacuaaucacagcuaacccaguggugaccaagaaggaggagcccgucaauauugaggcagaaccuccuuuuggggaaagcaacauagugauuggaauuggagacaaagcuuugaaaaucaacugguacaagaagggaagcucgauugggaagauguucgaggccacugccagaggugcaaggcgcauggccauccugggagauacagccugggacuuuggaucaguaggugguguuuuaaauucauuaggaaaaauggugcaucaaauauuuggaagugcuuauacggcccuauuuaguggagucuccuggauaaugaaaauuggaauagguguccuuuuaaccuggauaggguugaacucaaaaaacacuucuaugucauuuucaugcauugugauaggaaucaucacacucuaucugggagccguggugcaagcugacauggggugugucauaaacuggaaaggcaaagaacucaaauguggaaauggaauuuucgucacuaaugagguccauaccuggacagagcaauacaaauuucaagcagacucccccaaaagacuggcgacagccauugcaggcgcuugggagaauggagugugcggaauuaggucaacaaccagaauggagaaccucuuguggaagcaaauagccaaugaacugaacuacauauuaugggaaaacaacaucaaauuaacgguaguugugggcgacauaauuggggucuuagagcaagggaaaagaacacuaacaccacaacccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagccgucaaggaugagagggccguacacgccgacaugggcuauuggauagaaagccaaaagaauggaaguuggaagcuagaaaaagcaucccucauagaggugaaaaccugcacauggccaaaaucacacacucuuuggagcaauggugugcuagagagugacaugauuaucccaaagagucuagcuggucccauuucgcaacacaaccacaggcccggguaccacacccaaacggcaggacccuggcacuuaggaaaguuggagcuggacuucaacuauugugaaggaacaacaguugucaucacagaaaauugugggacaagaggcccgucacugaggacaacaacagugucagggaaguugauacacgaaugguguugccgcucguguacacuuccuccccugcgauacaugggagaggacggcugcugguauggcauggaaauuagacccauuaaugagaaagaagagaacaugguaaagucuuuagucucagcagggaguggaaagguggauaacuucacaauggguguccuguguuuggcaauccucuuugaggaagugaugagaggaaaauuugggaaaaaacacaugauugcagggguucucuucacguuugugcuccuucucucagggcaaauaacauggagagacauggcgcacacacucauaaugauuggguccaacgccucugacagaaugggaaugggugucacuuaccuagcauugauugcaacauuuaaaauccagccauuuuuggcuuugggauucuuucugaggaaacugacaucuagagaaaauuuauuguugggaguuggguuggccauggcaacaacguuacaacugccagaggacauugaacaaauggcgaauggaguagcuuuggggcuuauggcucuuaaauuaauaacacaauuugaaacauaccaacuguggacggcacuagucucccuaauguguucaaacacaauuuucacguugacuguugccuggagaacagccacccugauuuuggcuggaauuucgcuuuugccagugugccagucuucgagcaugaggaaaacagauuggcucccaaugacuguggcagcuaugggaguuccaccucuaccacuuuuuaucuucaguuugaaggacacgcucaaaaggagaagcuggccacugaaugagggggugauggccauuggacuugugagcauucuggcuaguucucuccuuaggaaugacgugcccauggcuggaccauuaguggcugggggcuugcugauagcgugcuaugucauaacuggcacgucagcagaccucacuguagaaaaagcagcagaugugacaugggaggaagaggcugagcaaacaggagugucccacaauuuaaugaucacaguugaugaugauggaacaaugagaauaaaagaugaugagacugagaacauccuaacagugcuuuugaaaacagcauuacuaauagugucaggcauuuuuccguacuccauacccgcaacacugcuggucuggcacaccuggcaaaagcaaacccaaagauccggcguccuaugggacguacccagccccccagagacucagaaggcagaacuggaagaagggguuuauaggauuaagcagcaaggaauuuuugggaaaacccaaguggggguuggaauacaaaaagaaggaguuuuccacaccauguggcacguuacaagaggagcaguguugacacacaaugggaaaagacuggaaccaaacugggcuagcgugaaaaaagaccugauuucauacggaggaggauggagauuaagugcacaauggcaaaaaggagaggaggugcagguuaucgccguagagccugggaagaacccaaagaacuuucaaacuaugccaggcauuuuccagacaacaacaggggagauaggagcgauugcacuggacuucaagccuggaacuucaggaucccccaucauaaacagagagggaaagguagugggacuguauggcaauggaguggucacaaagaaugguggcuaugucaguggaauagcacaaacaaaugcagaaccagacggaccgacaccagaguuggaagaagaaauguucaaaaagcgaaaucuaacuauaauggaucuccaucccgggucaggaaagacacggaaauaccuuccaacuauugucagagaggcaaucaagagacgcuuaaggacucuaauuuuggcgccaacaagggugguugcagcugagauggaagaagcauugaaagggcucccaauaagguaucaaacaacugcaacgaaaucugaacauacagggaaagagauuguugaucuaaugugccacgcaacguucacaaugcguuugcugucgccagucagaguuccaaacuacaacuugauaauaauggaugaggcucauuucacagacccagccaguauagcggcuagaggguacauaucaacucguguaggaaugggagaggcagccgcaauuuucaugacagccacacccccuggaacagcugaugccuuuccucagagcaacgcuccaauucaagaugaagaaagggacauaccagaacgcucauggaauucaggcaaugaauggauuaccgacuuugucgggaagacggugugguuugucccuagcaucaaagcuggaaaugacauagcaaacugcuuacggaaaaacggaaaaaaggucauucaacuuaguaggaagacuuuugacacagaauaucaaaagacuaaacuaaaugauugggacuuuguggugacaacagacauuucagaaaugggagccaauuucaaagcagacagagugaucgacccaagaagaugccucaagccagugaucuugacagacggacccgagcgcgugauccuagcgggaccaaugccaguuaccguagcgagcgcugcgcagaggagagggaggguuggcaggaacccacaaaaggaaaaugaccaauacauauucacgggccagccccuuaauaaugaugaagaccacgcucacuggacagaagcaaaaaugcugcuagauaacaucaacacaccagaagggaucauaccagcucucuuugaaccagaaagggagaagucagccgccauagauggcgaauaccgccugaaaggugaguccaggaagaccuucguggaacucaugaggaggggugaccucccagucuggcuagcccauaaaguagcaucagaagggaucaaauacacagauagaaaaugguguuuugauggagaacgcaacaaucaaauuuuagaggagaauauggauguggaaaucuggacaaaggaaggagaaaagaagaaauugaggccuagguggcuugaugcccgcacuuauucagaucccuuggcgcucaaggaauucaaggacuuugcggcugguagaaagucaauugcccuugaucuugugacagaaauaggaagagugccuucacacuuagccuacagaacgagaagcgcccuggacaaucuggugauguugcacacgucagaacauggcgggagggccuacaggcaugcaguggaggaacuaccagaaacaauggaaacacucuuacuccugggacucaugauccuguuaacaggcggggcaaugcuuuucuugauaucagguaaagggauuggaaagacuucaauaggacucauuuguguaguugcuuccagcgguauguuauggauggcugaugucccacuccaauggaucgcgucggccauaguccuggaguuuuuuaugauggugcuacucauaccagaaccagaaaagcagagaacuccucaagacaaucaacucgcauaugucgugauaggcauacuuacauuggcugcaauaguagcagccaaugaaaugggacuguuggaaaccacaaagagagauuuaggaauguccaaagaaccaggugucguuucuccaaccaguuacuuggauguggacuugcacccagcaucagcuuggacauuguacgcuguggccacaacaguaauaacaccaauguugagacauaccauagagaauuccacagcaaaugugucccuggcagcuauagccaaccaggcagugguccugauggguuuagacaaaggauggccgauaucgaaaauggacuuaggcguaccacuacuggcacuggguuguuauucacaagugaacccacuaacucucacagcggcaguacuucugcuagucacgcauuaugccauuauagguccaggauugcaggcaaaagccacccgugaagcucaaaaaaggacagcagcuggaauaaugaagaauccaacgguggaugggauaaugacaauagaccuagauccugugauauacgauucaaaauuugaaaagcaacuaggacagguuaugcuccugguucugugugcaguucaacuuuugcuaaugagaacaucaugggcuuuuugugaagcucuaacccuagccacaggaccgauaacaacacucugggaaggaucaccugggaaguuuuggaauaccacgauagcugucuccauggcgaacaucuuuagagggagcuacuuagcaggagcugggcuugcuuuuucuaucaugaaaucaguuggaacaggaaagagaggaacagggucacaaggugaaaccuugggagaaaaguggaaaaagaaauugaaucaguuaucccggaaagaguuugaucuuuacaagaaauccggaaucacugaaguggauagaacaaaagccaaagaaggguugaaaagaggggaaacaacacaccacgccguauccagaggcagcgcaaaacuucaaugguucguggagagaaacauggucauccccgaaggaagagucauagacuugggcuguggaagaggaggcuggucauauuauugugcgggacugaaaaaaguuacagaagugcgaggauacacaaaaggcggcccaggacaugaagaaccaguacccaugucuacauacggauggaacauagucaaguuaaugaguggaaaggauguguuuuaucuuccaccugaaaagugugauacccuauugugugacauuggagaaucuucaccaagcccaacaguggaagaaagcagaaccauaagaguccugaagaugguugaaccauggcuaaaaaauaaccaguuuugcauuaaaguauugaacccuuacaugccaacugugauugagcaccuagaaagacuacaaagaaaacauggaggaaugcuugugagaaauccacucucacgaaacuccacgcacgaaauguacuggauaucuaauggcacaggcaauaucgucucuucagucaacaugguauccagauugcuacugaacagauucacaaugacacauaggagacccaccauagagaaagauguggauuuaggagcggggacccgacacgucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaagccacaggcucagccuccuccaugauaaauggagucgugaagcuccucacgaaaccaugggauguggugcccacggugacacagauggcaaugacggauacaaccccauucggccagcaaaggguuuuuaaagagaaaguggacaccaggacacccagaccuaugccaggaacaagaaagguuauggagaucacagcggaauggcuuuggagaacccuaggaaggaauaaaagacccagacuaugcacgagagaggaguucacaaaaaaggucagaaccaacgcagcuaugggcgccguuuucacagaggagaaccaaugggacagugcuagagcugccguugaagaugaagaauucuggaaacucguggacagagaacgugaacuccacaagcugggcaaguguggaagcugcguuuacaacaugaugggcaagagagagaagaaacuuggagaguuuggcaaagcaaaaggcaguagagcuauaugguacaugugguugggagccagguaccuugaguucgaggcacucggauucuuaaaugaagaccauugguucucgcgugaaaauucuuacaguggaguagaaggagaaggacugcauaagcugggauacaucuuaagagauauuuccaagacacccggaggagcuauguaugcugaugacacagcugguugggacacaagaauaacagaagaugaccugcacaaugaggaaaaaaucacacagcaaauggacccugaacacaggcaguuagcaaacgcuauauuuaagcucacauaccaaaacaaaguggucaaaguucaacgaccaacuccaaagggcacgguaauggacaucauaucuaggaaagaccaaagagguaguggacaggugggaacuuauggcuugaauacauuuaccaacauggaagcccaguuaaucagacaaauggaaggagaagguguguugucgaaggcagaccucgagaacccucaucugccagagaagaaaaucacacaaugguuagaaaccaaaggaguagagagguuaaaaagaauggccaucagcggggaugauuguguggugaaaccaauugaugacagguucgccaaugcccugcuugcccugaaugacaugggaaaaguuaggaaggacauaccucaauggcagccaucgaagggauggcaugauuggcaacaggucccuuucugcucccaccacuuucaugaauugaucaugaaagauggaagaaagcugguaguucccugcagaccccaggaugaauuaauagggagagcgagaaucucucaaggagcaggauggagccuuaaagaaacugcaugccuagggaaagccuacgcccaaauguggagucucauguauuuucacagaagagaucuuagacuagcaucuaacgccauauguucagcaguaccaguccauuggguccccacaagcagaacgacguggucuauucaugcucaccaucaguggaugacuacagaagacaugcuuacuguuuggaacaggguguggauagaggauaauccauggauggaggauaaaacuccagucacaacuugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucgaugaagagauucaggaaggaggaggagucagagggagccauuugguaa

SEQ ID NO: 7766 - RNA, 9873 nt, Artificial Sequence
  derived and/or modified CDS sequence (wt) from DENV-3__DQ675521__SS-prME
acaucguucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuccuugcccauuacauaggcacuucccugacccagaaagugguuauuuuuauucuacuaaugcuggucacuccauccaugacaaugagaugcgugggaguaggaaacagagacuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaaucaccaacauaacaacugacucaagguguccuacccaaggggaagcgauuuuaccugaggagcaggaccagaacuacguauguaagcacacauacguggauagagguuggggaaacgguuguggcuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacgccccaggcaucaaccguugaagcuguccugccugaguauggaacccuugggcuagaaugcucaccacggacaggcuuggauuucaaugaaaugauucuauugacaaugaagaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacagagauucaaaauucaggagguacgagcauuuuugcggggcauuugaaauguagacuuaagauggacaaauuggaacucaaggggaugagcuaugcaaugugcuugaauaccuuuguguugaagaaggaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagccuuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaauacaaaauuccucuuucauaauagaugggccaaacacaccggaguguccaagugccucaagagcauggaaugugugggagguggaagauuacgguuuuggagucuucacaaccaacauauggcugaaacuccgagagauguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuucaacuauugcgaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagacccaucaaugagaaagaagagaacaugguaaagucuuuagucucagcagggaguggaaagguggacaacuucacaaugggaguccuguguuuggcaauucucuucgaagaggugaugagaggaaaauuugggaaaaaacacaugauuguagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacaucuuaacagugcucuuaaaaacagcauuacuaauaguaucaggcaucuuuccauacuccauacccgccacacuguuggucuggcacacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggagugguuacuaaaaaugguggcuacgucaguggaauagcgcaaacaaaugcagaaccagacggaccgacaccggaauuggaagaggaaauguucaaaaagcgaaaucuaaccauaauggaucuucauccugggucaggaaagacgcggaaauaucuuccagccauugucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucugaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuucccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauucaacuuaguaggaagacuuuugacacagaauaucaaaagaccagacugaaugauugggacuucguggugacaacagacauuucagaaaugggagcuaacuuuagagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuuuaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguaggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacucuauugugugacauuggagaaucuucaccaaguccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacauguuaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuucucacaaaaccaugggauguaguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaagugcggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgagcgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgauaugggaaagguuaggaaggacauaccucaauggcagccaucaaagggguggcaugauuggcaacaggucccuuucugcucccaccacuuucaugaacugauuaugaaagauggaagaaaguuggugguucccugcagaccccaggacgaacuaauaggaagggcaagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7767 - RNA, 9873 nt, Artificial Sequence
  derived and/or modified CDS sequence (wt) from DENV-3__DQ675522__SS-prME
acaucguucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuccuugcccauuacauaggcacuucccugacccagaaagugguuauuuuuauucuacuaaugcuggucacuccauccaugacaaugagaugcgugggaguaggaaacagagacuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaaucaccaacauaacaacugacucaagguguccuacccaaggggaagcgauuuuaccugaggagcaggaccagaacuacguauguaagcacacauacguggauagagguuggggaaacgguuguggcuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacgccccaggcaucaaccguugaagcuguccugccugaguauggaacccuugggcuagaaugcucaccacggacaggcuuggauuucaaugaaaugauucuauugacaaugaagaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacagagauucaaaauucaggagguacgagcauuuuugcggggcauuugaaauguagacuuaagauggacaaauuggaacucaaggggaugagcuaugcaaugugcuugaauaccuuuguguugaagaaggaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagccuuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaauacaaaauuccucuuucauaauagaugggccaaacacaccggaguguccaagugccucaagagcauggaaugugugggagguggaagauuacgguuuuggagucuucacaaccaacauauggcugaaacuccgagagauguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuucaacuauugcgaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagacccaucaaugagaaagaagagaacaugguaaagucuuuagucucagcagggaguggaaagguggacaacuucacaaugggaguccuguguuuggcaauucucuucgaagaggugaugagaggaaaauuugggaaaaaacacaugauuguagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacaucuuaacagugcucuuaaaaacagcauuacuaauaguaucaggcaucuuuccauacuccauacccgccacacuguuggucuggcacacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaggaaauguucaaaaagcgaaaucuaaccauaauggaucuucauccugggucaggaaagacgcggaaauaucuuccagccauugucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucugaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuucccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauucaacuuaguaggaagacuuuugacacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuuuaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguaggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacucuauugugugacauuggagaaucuucaccaaguccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacauguuaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuucucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaagugcggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgagcgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgauaugggaaagguuaggaaggacauaccucaauggcagccaucaaagggguggcaugauuggcaacaggucccuuucugcucccaccacuuucaugaacugauuaugaaagauggaagaaaguuggugguucccugcagaccccaggacgaacuaauaggaagggcaagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7768 - RNA, 9873 nt, Artificial Sequence
  derived and/or modified CDS sequence (wt) from DENV-3__DQ675527__SS-prME
acaucguucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuccuugcccauuacauaggcacuucccugacccagaaagugguuauuuuuauucuacuaaugcuggucacuccauccaugacaaugagaugcgugggaguaggaaacagagacuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaaucaccaacauaacaacugacucaagguguccuacccaaggggaagcgauuuuaccugaggagcaggaccagaacuacguauguaagcacacauacguggauagagguuggggaaacgguuguggcuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacgccccaggcaucaaccguugaagcuguccugccugaguauggaacccuugggcuagaaugcucaccacggacaggcuuggauuucaaugaaaugauucuauugacaaugaagaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacagagauucaaaauucaggagguacgagcauuuuugcggggcauuugaaauguagacuuaagauggacaaauuggaacucaaggggaugagcuaugcaaugugcuugaauaccuuuguguugaagaaggaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagccuuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaauacaaaauuccucuuucauaauagaugggccaaacacaccggaguguccaagugccucaagagcauggaaugugugggagguggaagauuacgguuuuggagucuucacaaccaacauauggcugaaacuccgagagauguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuucaacuauugcgaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagacccaucaaugagaaagaagagaacaugguaaagucuuuagucucagcagggaguggaaagguggacaacuucacaaugggaguccuguguuuggcaauucucuucgaagaggugaugagaggaaaauuugggaaaaaacacaugauuguagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacaucuuaacagugcucuuaaaaacagcauuacuaauaguaucaggcaucuuuccauacuccauacccgccacacuguuggucuggcacacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaggaaauguucaaaaagcgaaaucuaaccauaauggaucuucauccugggucaggaaagacgcggaaauaucuuccagccauugucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucugaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuucccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauucaacuuaguaggaagacuuuugacacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacgcauuaaucaaauuuuagaggagaacauggauguggaaaucuggacaaaggaaggagaaaggaaaaauuugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuuuaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguaggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacucuauugugugacauuggagaaucuucaccaaguccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacauguuaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuucucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaagugcggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgagcgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgauaugggaaagguuaggaaggacauaccucaauggcagccaucaaagggguggcaugauuggcaacaggucccuuucugcucccaccacuuucaugaacugauuaugaaagauggaagaaaguuggugguucccugcagaccccaggacgaacuaauaggaagggcaagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7769 - RNA, 9873 nt, Artificial Sequence
  derived and/or modified CDS sequence (wt) from DENV-3__DQ675528__SS-prME
acaucguucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuccuugcccauuacauaggcacuucccugacccagaaagugguuauuuuuauucuacuaaugcuggucacuccauccaugacaaugagaugcgugggaguaggaaacagagacuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaaucaccaacauaacaacugacucaagguguccuacccaaggggaagcgauuuuaccugaggagcaggaccagaacuacguauguaagcacacauacguggauagagguuggggaaacgguuguggcuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacgccccaggcaucaaccguugaagcuguccugccugaguauggaacccuugggcuagaaugcucaccacggacaggcuuggauuucaaugaaaugauucuauugacaaugaagaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaaguaguuguccuuggaucgcaagagggagcaaugcacacagugcugacaggagcuacagagauucaaaauucaggagguacgagcauuuuugcggggcauuugaaauguagacuuaagauggacaaauuggaacucaaggggaugagcuaugcaaugugcuugaauaccuuuguguugaagaaggaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccauucugggagacaccgcuugggacuuugguucagugggugguguucuaaauucauuagggaaaauggugcaccaaauauucggaagugcuuacacagccuuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaauacaaaauuccucuuucauaauagaugggccaaacacaccggaguguccaagugccucaagagcauggaaugugugggagguggaagauuacgguuuuggagucuucacaaccaacauauggcugaaacuccgagagauguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuucaacuauugcgaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagacccaucaaugagaaagaagagaacaugguaaagucuuuagucucagcagggaguggaaagguggacaacuucacaaugggaguccuguguuuggcaauucucuucgaagaggugaugagaggaaaauuugggaaaaaacacaugauuguagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugccuauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacaucuuaacagugcucuuaaaaacagcauuacuaauaguaucaggcaucuuuccauacuccauacccgccacacuguuggucuggcacacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaggaaauguucaaaaagcgaaaucuaaccauaauggaucuucauccugggucaggaaagacgcggaaauaucuuccagccauugucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucugaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuucccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauucaacuuaguaggaagacuuuugacacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuuuaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguaggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacucuauugugugacauuggagaaucuucaccaaguccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacauguuaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuucucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggccaugggagcuguuuucacagaggagaaccaaugggauagugcgagagcugcuguugaggacgaggaauucuggaaacuuguggacagagaacgugaacuccacaaauugggcaagugcggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgagcgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgauaugggaaagguuaggaaggacauaccucaauggcagccaucaaagggguggcaugauuggcaacaggucccuuucugcucccaccacuuucaugaacugauuaugaaagauggaagaaaguuggugguucccugcagaccccaggacgaacuaauaggaagggcaagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7770 - RNA, 9873 nt, Artificial Sequence
  derived and/or modified CDS sequence (wt) from DENV-3__DQ675530__SS-prME
acaucguucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuacggaacgugcaaucaagcuggggagcauagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuccuugcccauuacauaggcacuuccccgacccagaaagugguuauuuuuauucuacuaaugcuggucacuccauccaugacaaugagaugcgugggaguaggaaacagagacuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaaucaccaacauaacaacugacucaagguguccuacccaaggggaagcgauuuuaccugaggagcaggaccagaacuacguauguaagcacacauacguggauagagguuggggaaacgguuguggcuuguuuggaaaaggaagcuuggugacaugcgcgaaauuucaaugucuagaaccaauagagggaaaaguggugcaauaugagaaccucaaauacacugucaucaucacagugcacacaggagaccaacaccaggugggaaaugacacgcagggagucacgguugagauaacgccccaggcaucaaccguugaagcuguccugccugaguauggaacccuugggcuagaaugcucaccacggacaggcuuggauuucaaugaaaugauucuauugacaaugaagaacaaagccuggaugguacauaggcaaugguucuuugaccuaccccuaccauggacaucaggagccacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacagagauucaaaauucaggagguacgagcauuuuugcggggcauuugaaauguagacuuaagauggacaaauuggaacucaaggggaugagcuaugcaaugugcuugaauaccuuuguguugaagaaggaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagccuuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaauacaaaauuccucuuucauaauagaugggccaaacacaccggaguguccaagugccucaagagcauggaaugugugggagguggaagauuacgguuuuggagucuucacaaccaacauauggcugaaacuccgagagauguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggauaccacacccaaacggcaggaccuuggcacuugggaaaauuggagcuggacuucaacuauugcgaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagacccaucaaugagaaagaagagaacaugguaaagucuuuagucucagcagggaguggaaagguggacaacuucacaaugggaguccuguguuuggcaauucucuucgaagaggugaugagaggaaaauuugggaaaaaacacaugauuguagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacaucuuaacagugcucuuaaaaacagcauuacuaauaguaucaggcaucuuuccauacuccauacccgccacacuguuggucuggcacacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccggguauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaggaaauguucaaaaagcgaaaucuaaccauaauggaucuucauccugggucaggaaagacgcggaaauaucuuccagccauugucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucugaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuucccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauucaacuuaguaggaagacuuuugacacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuuuaugaugguguugcucauaccagaaccagaaaaacaaagaacuccccaagacaaccaacucgcauaugucgugauaggcauacuuacacuggcugcgauaguagcagcuaaugaaaugggauuauuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuaguuacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggagcugggcuugcuuuuucuaucaugaaaucaguaggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacucuauugugugacauuggagaaucuucaccaaguccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacauguuaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuucucacaaaaccaugggaugugguucccauggugacacagauggcaaugacagauacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaagugcggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgagcgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgauaugggaaagguuaggaaggacauaccucaauggcagccaucaaagggguggcaugauuggcaacaggucccuuucugcucccaccacuuucaugaacugauuaugaaagauggaagaaaguuggugguucccugcagaccccaggacgaacuaauaggaagggcaagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuaccgucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7771 - RNA, 9873 nt, Artificial Sequence
  derived and/or modified CDS sequence (wt) from DENV-3__DQ675533__SS-prME
acaucgcucugucucaugaugauauugccagcagcacuugcuuuccacuugacuucacgagauggagagccgcgcaugauuguggggaagaaugaaagaggaaaaucccuacuuuuuaagacagccucuggaaucaacaugugcacacucauagccauggauuugggagagaugugugaugacacggucacuuacaaaugcccccacauuaccgaaguggaaccugaagacauugacugcuggugcaaccuuacaucaacaugggugacuuauggaacgugcaaucaagcuggagagcauagacgcgacaagagaucaguggcguuagcuccccaugucggcaugggacuggacacacgcacccaaaccuggaugucggcugaaggagcuuggagacaagucgagaagguagagacaugggcccuuaggcacccaggguucaccauacuagcccuauuucucgcccauuacauaggcacuucccugacccagaaggugguuauuuucauauuauuaaugcuggucaccccauccaugacaaugagaugugugggaguaggaaacagagauuuuguggaagggcuaucaggagcuacguggguugacguggugcucgagcacggggggugugugacuaccauggcuaagaacaagcccacgcuggauauagagcuucagaagaccgaggccacccaacuggcgacccuaaggaagcuaugcauugagggaaaaauuaccaacauaacaacugacucaagauguccuacccaaggggaagcgguuuugccugaggagcaggaccagaacuacguguguaagcauacauacguagacagaggcugggggaacgguugugguuuguuuggcaaaggaagcuuggugacaugcgcgaaauuucaaugccuggaaccaauagagggaaaaguggugcaauaugagaaccucaaauacaccgucaucauuacagugcacacaggagaccaacaccaggugggaaaugaaacgcaaggagucacggcugagauaacaccucaggcaucaacccaugaagcacucuugccugaauauggaacccuugggcuagaaugcucaccacggacagguuuggauuucaaugaaaugaucuuacuaacaaugaagaacaaagcauggaugguacauagacaaugguucuuugaccuaccucuaccaugggcaucaggagcuacaacagaaacaccaaccuggaacaggaaggagcuucuugugacauucaaaaacgcacaugcgaaaaaacaagaaguaguuguccuuggaucgcaagagggagcaaugcauaccgcacugacaggagcuacagaaauccaaaacucaggaggcacaagcauuuucgcggggcacuuaaaauguagacuuaagauggacaaauuggaacucaaggggaugagcuaugcaaugugcacgaauaccuuuguguugaagaaagaagucucagaaacgcagcacgggacaauacucauuaagguugaguacaaaggggaagaugcaccuugcaagauucccuuuuccacagaggauggacaagggaaagcucacaauggcagacugaucacagccaacccuguggugacuaagaaggaggagccugucaauauugaggcugaaccuccuuuuggggaaagcaauauaguaauuggaauuggagacaacgccuugaaaaucaacugguacaagaaggggagcucgauugggaagauguucgaggccacugccaggggugcaaggcgcauggccaucuugggagacacagcuugggacuuuggaucagugggugguguucugaacucauuaggcaaaauggugcaccaaauauuuggaagugcuuauacagcccuguucaguggagucucuugggugaugaaaauuggaauagguguccucuugacuuggauaggguugaauucaaaaaacacauccaugucauuuucaugcauugcgauaggaaucauuacacucuaucugggagcugugguacaagcugacauggggugugucauaaacuggaagggcaaagaacucaaauguggaagcggaauuuucgucaccaaugagguccauacuuggacagagcaauacaaauuccaagcagacuccccaaaaagauuggcaacagccauugcaggcgcuugggagaauggaguguguggaauuaggucaacaaccagaauggagaaucucuuguggaagcaaauagccaaugaacugaacuacauauuaugggaaaacaauaucaaauuaacgguaguugugggcgauacacuuggggucuuagagcaagggaaaagaacacuaacaccacaacccauggagcuaaaauacucauggaaaacguggggaaaggcaaaaauagugacagcugaaacacaaaauuccucuuucauaauagacgggccaaacacaccggaguguccaagugccucaagagcauggaaugugugggagguggaagauuacggguucggagucuucacaaccaacauauggcugaaacuccgagagguguacacccaacuaugugaccauaggcuaaugucggcagcugucaaggaugagagggccgugcaugccgacaugggcuacuggauagaaagccaaaagaauggaaguuggaagcuagaaaaagcaucccucauagagguaaaaaccugcacauggccaaaaucacacacucucuggaguaauggugugcuagagagugacaugaucaucccaaagagucuagcugguccuaucucacaacacaacuacaggcccggguaccacacccaaacggcaggacccuggcacuuaggaaaauuggagcuggacuucaacuacugugaaggaacaacaguugucaucacagaaagcugugggacaagaggcccaucauugagaacaacaacagugucagggaaguugauacacgaaugguguugccgcucgugcacacuucccccccugcgauacaugggagaagacggcugcugguauggcauggaaaucagacccaucagugagaaagaagagaacaugguaaagucuuuagucucagcgggaaguggaaagguggacaacuucacaaugggugucuuguguuuggcaauccucuuugaagagguguugagaggaaaauuugggaagaaacacaugauugcagggguuuucuuuacguuugugcuccuucucucagggcaaauaacauggagagacauggcgcacacacuaauaaugaucggguccaacgccucugacaggaugggaaugggcgucaccuaccuagcucuaauugcaacauuuaaaauccagccauucuuggcuuugggauuuuuccuaagaaagcugacaucuagagaaaauuuauuguuaggaguuggguuggccauggcaacaacguuacaacugccagaggacauugaacaaauggcaaauggaaucgcucuggggcucauggcucuuaaacugauaacacaauuugaaacauaccaauuguggacggcauuagucuccuuaacguguucaaacacaauuuuuacguugacuguugccuggagaacagccacucugauuuuggccggaguuucgcuuuuaccagugugccagucuucaagcaugaggaaaacagauuggcucccaaugacaguggcagcuaugggaguuccaccccuuccacuucuuauuuuuagcuugaaagacacacucaaaaggagaagcuggccacugaaugaaggggugauggcuguugggcuugugagcauucuggccaguucucuccuuagaaaugaugugcccauggcuggaccauuaguggccgggggcuugcugauagcgugcuacgucauaacuggcacgucagcggaccucacuguagaaaaagcagcagauguaacaugggaggaagaggcugagcagacaggagugucccacaacuuaaugaucacaguugaugaugauggaacaaugagaauaaaagaugaugagacugagaacauccuaacagugcuuuuaaaaacagcauuacuaauaguaucaggcauuuuuccauacuccauacccgcaacauuguuggucuggcacacuuggcaaaaacaaacccaaagauccggcguuuuaugggacguacccagccccccagagacacagaaagcagaacuggaagaagggguuuauaggaucaaacagcaaggaauuuuugggaaaacccaaguagggguuggaguacagaaagaaggagucuuccacaccauguggcacgucacaagaggggcaguguugacacauaaugggaaaagacuggaaccaaacugggcuagugugaaaaaagaucugauuucauauggaggaggauggagacugagcgcacaauggcaaaagggggaggaggugcagguuauugccguagagccagggaagaacccaaagaacuuucaaaccaugccaggcacuuuucagacuacuacaggggaaauaggagcaauugcauuggauuucaagccuggaacuucaggaucuccuaucauaaauagagagggaaagguagugggacuguauggcaauggagugguuacaaagaaugguggcuaugucagcggaauagcgcaaacaaaugcagaaccagauggaccgacaccagaguuggaagaagagauguucaaaaagcgaaaccugaccauaauggaucuucauccugggucaggaaagacacggaaauaccuuccagcuauugucagagaggcaaucaagagacguuuaagaaccuuaauuuuggcaccgacaagggugguugcagcugagauggaagaagcauugaaagggcucccaauaagguaccaaacaacagcaacaaaaucugaacacacaggaagagagauuguugaucuaaugugccacgcaacguucacaaugcguuugcugucaccaguuaggguuccaaauuacaacuugauaauaauggaugaggcccauuucacagacccagccaguauagcggcuagaggguacauaucaacucguguuggaaugggagaggcagccgcaaucuucaugacagcaacacccccuggaacagcugaugccuuuccucagagcaacgcuccaauucaagaugaagaaagggacauaccagaacgcucauggaauucaggcaaugaauggauuaccgacuucgcugggaaaacggugugguuugucccuagcauuaaagccggaaaugacauagcaaacugcuugcgaaaaaacgggaaaaaagucauucaacuuaguaggaagacuuuugacacagaauaucagaagacuaaacugaaugauugggacuuuguggugacaacugacauuucagaaaugggggccaauuucaaagcagauagagugaucgacccaagaagaugucucaaaccagugaucuugacagauggaccagagcgggugauccuggccggaccaaugccagucaccgcggcgagugcugcgcaaaggagagggagaguuggcaggaacccacaaaaagaaaaugaccaguacauauucacgggccagccucucaacaaugaugaagaccaugcucacuggacagaagcaaaaaugcugcuggacaacaucaacacaccagaagggauuauaccagcucucuuugaaccagaaagggagaagucagccgccauagacggugaguaucgccugaagggugaguccaggaagacuuucguggaacucaugaggaggggugaccucccaguuuggcuagcccauaaaguagccucagaagggaucaaauacacagauagaaaauggugcuuugauggagaacgcaauaaucaaauuuuagaggagaacauggauguggaaaucuggacaaaggaaggagaaaggaaaaaauugagaccuagguggcuugaugcccgcacuuauucagauccccuagcacucaaggaauucaaggauuuugcagcuggcagaaagucaaucgcccuugaucuugugacagaaauaggaagagugccuucacacuuagcccacagaacgagaaacgcccuggacaauuuggugaugcugcauacgucagaacauggcgguagggcuuacaggcaugcgguggaggaacuaccagaaacaauggaaacacuccuacucuugggacuuaugaucuuguugacagguggagcaaugcuuuucuugauaucagguaaagggauuggaaagacuucaauaggacucauuuguguaaucgcuuccagcggcauguuguggauggccgaaguuccacuccaauggaucgcgucggcuauaguccuggaguuuuuuaugaugguguugcucauaccagaaccagaaaagcagagaaccccccaagacaaccaacuugcauaugucgugauaggcauacuuacauuggcugcaauaauagcagccaaugaaaugggacugcuggaaaccacaaagagagacuuaggaaugucuaaggagccagguguuguuucuccaaccagcuauuuggauguggacuugcacccagcaucagccuggacauuguacgccguggccacuacaguaauaacaccaauguuaagacauaccauagagaauucuacagcaaaugugucccuggcagcuauagccaaccaggcagugguccugauggguuuggacaaaggauggccaauaucaaaaauggacuuaggcgugccacuacuggcacuggguugcuauucacaagugaacccacugacucuaacugcggcaguacuuuugcuaaucacacauuaugcuaucauagguccaggauugcaagcaaaagccacccgugaagcucagaaaaggacagcugcuggaauaaugaagaauccaacaguggaugggauaaugacaauagaccuagauccuguaauauaugauucaaaauuugaaaaacaacugggacagguuaugcuccugguuuugugcgcaguccaacucuugcuaaugagaacaucaugggccuugugugaagcuuuaacucuagcuacaggaccaauaacaacacucugggaaggaucaccugguaaguucuggaacaccacgauagcuguuuccauggcgaacauuuuuagagggagcuauuuagcaggagcugggcuugcuuuuucuauuaugaaaucaguuggaacaggaaaaagaggaacaggcucacaaggugaaacuuuaggagaaaaauggaaaaagaaauuaaaucaauuaucccggaaagaguuugaccuuuacaagaaaucuggaaucacugaaguggauagaacagaagccaaagaaggguugaaaagaggagagacaacacaucaugccgugucccgagguagcgcaaaacuucaaugguuuguggaaagaaacauggucguucccgaaggaagagucauagacuugggcuguggaagaggaggcuggucauauuacugugcaggacugaaaaaagucacagaagugcgaggauacacaaaaggcgguccaggacacgaagaaccaguaccuaugucuacauauggauggaacauaguuaaguuaaugagcggaaaggauguguucuaucucccaccugaaaagugugauacccuguugugugacauuggagaaucuucaccaagcccaacaguggaagagagcagaacuauaagaguuuugaagaugguugaaccauggcuaaaaaacaaccaguuuugcauuaaaguuuugaacccuuacaugccaacugugauugagcaccuagaaagacuacaaaggaaacauggaggaaugcuugugagaaauccacuuucacgaaacuccacgcacgaaauguacuggauaucuaauggcacagguaacauugucucuucagucaacauggugucuagauugcuacugaacagguucacgaugacacacaggagacccaccauagagaaagauguggauuuaggagcaggaacucgacauguuaaugcggaaccagaaacacccaacauggaugucauuggggaaagaauaaaaaggaucaaggaggagcauaauucaacauggcacuaugaugacgaaaaccccuacaaaacgugggcuuaccauggauccuaugaagucaaagccacaggcucagccuccuccaugauaaauggagucgugaaacuccucaccaaaccaugggauguggugcccauggugacacagauggcaaugacagacacaacuccauuuggccagcagagagucuuuaaagagaaaguggacaccaggacgcccaggcccaugccagggacaagaaagguuauggagaucacagcggaguggcucuggagaacccugggaaggaacaaaagacccagauuaugcacaagggaagaguuuacuaaaaaggucagaacuaacgcagccaugggcgccguuuucacagaggagaaccaaugggacagugcgaaagcugcuguugaggaugaagaauuuuggaaacuuguggacagagaacgugaacuccacaaauugggcaaauguggaagcugcguuuauaacaugaugggcaagagagagaaaaaacuuggagaguuuggcaaagcaaaaggcaguagagcuauaugguacaugugguugggagccagguaccuugaguucgaagcccuuggauucuuaaaugaagaccacugguucucgcgugaaaacucuuacaguggaguagaaggagaaggacugcacaagcuaggcuacauauuaagggacauuuccaagauacccggaggagccauguaugcugaugacacagcugguugggacacaagaauaacagaagaugaccugcacaaugaggaaaagaucauacagcaaauggacccugaacacaggcaguuagcgaacgcuauauucaagcucacauaccaaaacaaaguggucaaaguucaacgaccgacuccaacgggcacgguaauggauauuauaucuaggaaagaccaaaggggcaguggacaagugggaacuuauggccugaauacauucaccaacauggaagcccaguuagucagacaaauggaaggagaaggugugcugacaaaggcagaccucgagaacccucaucugcuagagaagaaaaucacacaauggcuggaaaccaaaggaguggagagguuaaaaagaauggccauuagcggggaugauugcguggugaaaccaaucgaugacagguucgcuaaugcccugcuugcuuugaacgauaugggaaagguucggaaagacauaccucaauggcagccaucaaagggauggcaugauuggcaacagguuccuuucugcucccaccacuuucaugaauugaucaugaaagauggaagaaaguuggugguucccugcagaccccaggacgaacuaauaggaagagcaagaaucucucaaggagcgggauggagccuuagagaaacugcaugucuggggaaagccuacgcccaaauguggagucucauguauuuucacagaagagaucucagauuagcauccaacgccauauguucagcaguaccaguccacuggguucccacaaguagaacgacauggucuauucaugcucaccaucaguggaugacuacagaagacaugcuuacuguuuggaacaggguguggauagaggaaaauccauggauggaagacaaaacuccaguuacaacuugggaaaauguuccauaucuagggaagagagaagaccaaugguguggaucacuuauuggucucacuuccagagcaaccugggcccagaacauacccacagcaauucaacaggugagaagccuuauaggcaaugaagaguuccuggacuacaugccuucaaugaagagauucaggaaggaagaggagucggagggagccauuugguaa

SEQ ID NO: 7772 - RNA, 9873 nt, Artificial Sequence
  derived and/or modified CDS sequence (wt) from DENV-3__AY744677__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcgucuuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucugaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagacuuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagagauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagauauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcccaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7773 - RNA, 9873 nt, Artificial Sequence
  derived and/or modified CDS sequence (wt) from DENV-3__AY744678__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaauguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacugcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacaccucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaaucuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcaggucauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagacauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccagugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7774 - RNA, 9873 nt, Artificial Sequence
  derived and/or modified CDS sequence (wt) from DENV-3__AY744679__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaagcuauguauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaaguggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauucccuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauagggaucauuacacucuaucugggagccguggugcaagcugacauggggugugucauaaacuggaaaggccaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgguaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccgucaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauucaaaauucagccauuuuuggcuuugggauucuuccugaggaaacugacauccagagaaaauuuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuggucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccucuaccacuuuucauuuucaguuuaaaagauacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcugcuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacucuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggauaucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuguguacgagagaggaguucaugaaaaaagucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguauaugugguugggagccagguaccuugaguucgaagcacucggauucuuaaaugaagaccauugguucucgcgugaaaacucuuacaguggaguagaaggagaaggacugcauaaacugggauacaucuuaagagauauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaagcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcgagaaucucucaaggagcaggauggagccucagagaaacugcaugccuagggaaagccuacgcccaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucucaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7775 - RNA, 9873 nt, Artificial Sequence
  derived and/or modified CDS sequence (wt) from DENV-3__AY744680__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgaccuuaaggaaacuauguauugagggaaaaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauucaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggauuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgccguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagauauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaauugggagagcuagaaucucucaaggagcaggauggagccucagagaaacugcaugccuagggaaagccuacgcccaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7776 - RNA, 9873 nt, Artificial Sequence
  derived and/or modified CDS sequence (wt) from DENV-3__AY744681__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucaucacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaagaauuaccaacguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaagugaaacgcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacacagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuuugucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacaugccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacggcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuuacugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcauuaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaagaaacaaaagacccagauuauguacgagagaggaguucauaaaaaaggucagaaccaacgcagcuaugggcgccguuuucacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagauauuuccaagauacccggaggagcuauguaugcugaugacacagcugguugggacacaagaauaacagaagaugaccugcacaaugaggaaaaaaucacacagcaaauggacccugaacacaggcgguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcccaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7777 - RNA, 9873 nt, Artificial Sequence
  derived and/or modified CDS sequence (wt) from DENV-3__AY744682__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuucguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaauguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaccaucacagugcacacaggagaucaacaccaggugggaaaugaaacgcagggagucacagcugagauaacaccccaggcaucaaccguugaagccauuuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagauaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucgaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagguguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggacaacuucacaaugggugucuuguguuuggcaauccucuuugaagaggugaugagaggaaaauuugggaaaaagcacaugauuucaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccacuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguauugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacagcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccgucgcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugagaaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagccgcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcacaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggacgaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagacauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccuuaccugcuagagaagaaaguuacacaaugguuggaaacaaaaggaguggagagguuaaaaagaauggccaucagcggggaugacugcguggugaaaccaaucgaugacagguuugccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaaugguguggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7778 - RNA, 9873 nt, Artificial Sequence
  derived and/or modified CDS sequence (wt) from DENV-3__AY744683__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagccccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaauguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacagcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguucgaggcuacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucaugcauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcaacagccauugcaggugcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuuuacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauccagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaaaccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccagucuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcagaugucccacuccaauggaucgcgucggccauaguccuggaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcugucgaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguuccuugaguucgaagcacucggauucuuaaaugaagaccauugguucucgcgugaaaacucuuacaguggaguagaaggagaaggacugcauaaacugggauacaucuuaagagacauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagaaaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacucacggcaauccaacaggugagaagccuuauaggcaaugaagaguuucuggacuacaugccuucaaugaagagauucaggaaggaggaggagucagagggagccauuugguaa

SEQ ID NO: 7779 - RNA, 9873 nt, Artificial Sequence
  derived and/or modified CDS sequence (wt) from DENV-3__AY744684__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucauuacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuuccuugacccagaaagugguuauuuucauacuacuaaugcuggucaccccauccaugacaaugagaugugugggaguaggaaacagagauuuuguggaaggccuaucaggagcuacguggguugacguggugcucgagcacggugggugugugacuacuauggcuaagaacaagcccacguuggauauagagcuccagaagaccgaggccacccaacuggcgacccuaaggaaacuauguauugagggaaaaauuaccaauguaacaaccgacucaaggugccccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaacgcagggagucacagcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaauggcagacugaucacagcuaacccaauagugaccaagaaggaggagccugucaacaucgaggcagaaccuccuuuuggggaaaguaauauaguaauuggaauuggagacaaagccuugaaaaucaacugguacaagaagggaagcucgauugggaagauguuugaggcuacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacacuucuaugucauuuucauguauugugauaggaaucauuacacucuaucugggagccguggugcaagcugacauggggugugucauaaacuggaaaggcaaagaacucaaauguggaaguggaauuuucgucacuaaugagguccacaccuggacagagcaauacaaauuucaagcggacucucccaaaagacuggcaacagccauugcaggugcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccucaagagcauggaaugugugggagguggaagauuacggguucggaguuuucacaacuaacauauggcugaaacuccgagagauguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugugaaggaacaacaguugucaucacagaaaauugugggacaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaaggcggauaacuucacaaugggugucuuguguuuggcaauccucuuugaagaggugaugagaggaaaauuugggaaaaagcacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuugggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuagucucccuaauguguucaaauacaauuuccacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacugaaugagggggugauggcuguuggacuugugagcauucuagcuaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaaguggggguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuccagacaacaacaggggagauaggagcgauugcacuggacuucaaaccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucaaacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagacauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugaucgacccaagaagaugucucaagccagugauuuugacagacggacccgagcgcgugauccuggcgggaccaaugccagucaccguagcgagcgcugcacaaaggagagggagaguuggcaggaacccacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaccaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcagaugucccacuccaauggaucgcgucggccauaguccuagaguuuuucaugaugguguuacuuauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaacccacuaacucucacagcggcaguacuccugcuagucacgcauuaugcuaucauagguccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugugcaguucaacuuuuguuaaugagaacaucaugggcuuuuugugaagcucuaacccuagccacaggaccaauaacaacacucugggaaggaucaccugggaaguucuggaacaccacgauagcuguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauacggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcaccuagaaagacuacaaaggaaacauggaggaaugcuugugagaaauccacucucacgaaacuccacgcacgaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggauacaaccccauucggccagcaaaggguuuuuaaagagaaaguggacaccaggacacccagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcugucgaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucuuacaguggaguagaaggagaaggacugcauaaacugggauacaucuuaagagacauuuccaagauacccggaggagcuauguaugcugaugacacagcugguugggacacaagaauaacagaagaugaccugcacaaugaggaaaaaaucacacagcaaauggacccugaacacaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcagaccucgagaacccucaccugcuagaaaagaaaguuacacaaugguuggaaacaaaaggaguggagagguuaaaaagaauggccaucagcggggaugauugcguggugaaaccaaucgaugacagauucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugacuacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagaaggagccauuugguaa

SEQ ID NO: 7780 - RNA, 9873 nt, Artificial Sequence
  derived and/or modified CDS sequence (wt) from DENV-3__AY744685__SS-prME
acaucgcucugucucaugaugauguuaccagcaacacuugcuuuccauuugacuucacgggauggagagccgcgcaugauuguggggaagaaugaaagaggaaaaucccuacuuuucaagacagccucuggaaucaacaugugcacacucauagccauggauuugggagagaugugugaugacacggucacuuacaaaugcccccucaucacugaaguggagccugaagacauugacugcuggugcaaccuuacaucgacaugggugaccuacggaacgugcaaucaagcuggagagcacagacgcgauaagagaucgguggcguuagcuccccaugucggcaugggacuagacacacgcacccaaaccuggaugucggcugaaggagcuuggagacaggucgagaagguagagacaugggccuuuaggcacccaggguucacaauacuagcccuauuucuugcccauuacauaggcacuucccugacccagaaagugguuauuuucauacuacuaaugcuggucaccccauccaugacaaugagaugugugggagugggaaacagagauuuuguggaaggccuaucaggagcuacguggguugacguggugcucgagcacggugggugugugaccacuauggcuaagaacaagcccacguuggauauagagcuccagaagaccgaggccacccaacuggcgacccuaaggaaacuauguauugagggaaaaauuaccaauguaacaaccgacucaaggugucccacccaaggggaagcgauuuuaccugaggagcaggaccagaacuacguguguaagcacacauacguggacagaggcuggggaaacgguugugguuuguuuggcaagggaagccugguaacaugcgcgaaauuucaauguuuggaaucaauagagggaaaagcggugcagcaugagaaccucaaauacaccgucaucaucacagugcacacaggagaucaacaccaggugggaaaugaaaugcagggagucacggcugagauaacaccccaggcaucaaccguugaagccaucuugccugaauauggaacccuugggcuagaauguucaccacggacaggucuagauuucaaugaaaugauuuuguugacaaugaagaacaaagcauggaugguacauagacaaugguuuuuugaccugccuuuaccauggacaucaggagcuacaacagaaacaccaaccuggaauaagaaagagcuucuugugacauucaaaaacgcacaugcaaaaaagcaagaaguaguaguccuuggaucgcaagagggagcaaugcacacagcacugacaggagcuacagagauccaaaccucaggaggcacaaguauuuuugcggggcacuuaaaauguagacucaagauggacaaauuggaacucaaggggaugagcuaugcaaugugcuugaaugccuucguguugaagaaagaagucucugaaacgcaacaugggacgauacucauuaagguugaguacaaaggggaagaugcaccuugcaagauuccuuucuccacggaggauggacaagggaaagcccacaacggcagacugaucacagcuaacccaauagugaccaagaaggaggagccugucaacaucgaggcagaaccuccuuuuggggaaaguaacauaguaauuggaauuggagacaaagccuugaaaaucaacugguacaagaagggaagcucgauugggaagauguucgaggccacugccagaggugcaaggcgcauggccaucuugggagacacagccugggacuuuggaucaguaggugguguuuuaaauucauuaggaaaaauggugcaccaaauauuuggaagugcuuacacagcccuauuuaguggagucuccuggauaaugaaaauuggaauagguguccuuuuaaccuggauaggguugaauucaaaaaacgcuucuaugucauuuucaugcauugugauaggaaucauuacacuauaucugggagcuguggugcaagcugacauggggugugucauaaacuggaaaggcaaagaacucaaauguggaaguggaauuuucgucacuaaugagguccacaccuggacagagcaauacaaauuucaagcggacucucccaaaagacuggcgacagccauugcaggcgcuugggagaauggagugugcggaaucaggucgacaaccagaauggagaaccuccuguggaagcaaauagcuaaugaacugaacuacauauuaugggaaaacaacaucaaauuaacgauaguugugggugauguaauuggggucuuagagcaggggaaaagaacacuaacaccacaacccauggaacuaaaauauucauggaaaacauggggaaaggcgaagauagugacagcugaaacacaaaauuccucuuucauaauagacgggccaaacacaccagaguguccaagugccuuaagagcauggaaugugugggagguggaagauuacggguucggaguuuucacaacuaacauauggcugaaacuccgagagaaguacacccaacuaugugaccacaggcuaaugucggcagccguuaaggaugagagggccguacacgccgacaugggcuauuggauagaaagccaaaagaauggaaguuggaagcuagaaaaggcaucccucauagagguaaaaaccugcacauggccaaaaucacacacucuuuggagcaauggugugcuagagagugacaugaucaucccaaagagucuggcuggucccauuucgcaacacaacuacaggcccggauaccacacccaaacggcaggacccuggcacuuaggaaaauuggagcuggacuucaacuauugcgaaggaacaacaguugucaucacagaaaauugugggauaagaggcccaucacugaggacaacaacagugucagggaaguugauacacgaaugguguugccgcucguguacgcuuccuccccugcgauacaugggagaagacggcugcugguauggcauggaaauuagacccauuaaugagaaagaagagaacaugguaaagucuuuagucucagcagggaguggaaagacggauaacuucacaaugggugucuuguguuuggcaauccucuuugaagaggugaugagaggaaaauuugggaaaaaacacaugauugcaggggcucucuucacguuugugcuccuucucucagggcaaauaacauggagagacauggcgcacacacucauaaugauuggguccaacgccucugacagaaugggaaugggcgucacuuaccuagcauugauugcaacauuuaaaauucagccauuuuuggcuuuaggauucuuccugaggaaacugacauccagagaaaaucuauugcugggaguuggguuggccauggcaacaacguuacaacugccagaggacauugaacaaauggcgaauggaauagcuuuagggcucauggcucuuaaauuaauaacacaauuugaaacauaccaacuauggacggcauuaaucucccuaauguguucaaacacaauuuucacguugacuguugccuggagaacagccacccugauuuuggccguaauuucucuuuugccagugugccagucuucgagcaugaggaaaacagauuggcucccaaugacuguggcagcuaugggaguuccaccccuaccacuuuucauuuucaguuuaaaagacacgcucaaaaggagaagcuggccacuaaaugagggggugauggcuguuggacuugugagcauucuagccaguucuuuccuuaggaaugacgugcccauggcuggaccauuaguggcugggggcuugcugauagcgugcuacgucauaacuggcacgucagcagaccucacuguagaaaaagcagcagaugugacaugggaggaagaggcugagcaaacaggagugucccacaauuuaaugaucacaguugaugacgauggaacaaugagaauaaaagaugaugagaccgagaacaucuuaacagugcuuuugaaaacagcauuacuaauagugucaggcauuuuuccauacuccauacccgcaacacuguugguuuggcacacuuggcaaaagcaaacccaaagguccggcguccuaugggacguucccagccccccagagacacagaaagcagaacuggaagagggggucuauaggaucaagcagcaaggaauuuuugggaaaacucaagugggaguuggaguacaaaaagaaggaguuuuucacaccauguggcacgucacaagaggagcaguguugacacacaaugggaaaagacuggaaccaaacugggcuaacgugaaaaaagaucugauuucauacggaggaggauggaaauugagugcacaauggcaaaaaggagaggaagugcagguuauugcuguagagccugggaagaacccaaagaacuuucaaaccaugccaggcauuuuucagacaacaacaggggagauaggagcgauugcacuggacuucaagccuggaacuucaggaucucccaucauaaacagagagggaaagguaguggggcuguauggcaauggaguggucacaaagaaugguggcuaugucaguggaauagcacaaacaaaugcagaaccagacggaccgacaccagaguuggaagaagagauguucaaaaagcgaaaucuaaccauaauggaucuccaucccgggucaggaaagacgcggaaauaucuuccagcuauuguuagagaggcaaucaagagacguuuaaggacucuaauuuuggcaccaacaaggguaguugcagcugagauggaagaagcauugaaagggcucccaauaagguaucagacaacugcaacaaaaucugaacacacagggagagagauuguugaucuaaugugccacgcaacguucacaaugcguuugcugucaccagucaggguuccaaacuacaacuugauaguaauggaugaggcucauuucacagacccagccaguauagcggcuagaggguacauaucaacucguguaggaaugggagaggcagcagcaauuuucaugacagccacacccccuggaacagcugaugcuuuuccucagagcaacgcuccaauucaagaugaagaaagagauauaccagaacgcucauggaauucaggcaaugaauggauuaccgacuuugccgggaagacggugugguuugucccuagcaucaaagcuggaaaugacauagcaaacugcuugcgaaaaaauggaaaaaaggucauucaacuuaguaggaagacuuuugacacagaauaucaaaagacuaaacugaaugauugggacuuuguggugacaacagacauuucagaaaugggagccaauuucaaagcagacagagugauugacccaagaagaugucucaagccagugaucuugacagacggacccgagcgcgugauccuggcgggaccaaugccagucaccguagcgagcgcugcacaaaggagagggagagucggcaggaacucacaaaaagagaaugaccaauacauauucacgggccagccccuuaauaaugaugaagaccaugcucacuggacagaagcaaaaaugcuguuagacaacaucaacacaccagaagggaucauaccagcucucuuugaaccagaaagggagaagucagccgccauagacggcgaauaccgccugaagggugaguccaggaagaccuucguggaacucaugaggaggggugaccucccaguuuggcuagcccauaaaguagcaucagaagggaucaaauacacagauagaaagugguguuuugauggagaacgcaauaaucaaauuuuagaggagaauauggauguggaaaucuggacaaaggaaggagagaagaaaaaauugagaccuagguggcuugaugcccgcacuuauucagauccauuagcgcucaaggaauucaaggacuuugcggcugguaggaagucaauugcccuugaucuugugacagaaauaggaagagugccuucacacuuagcucacagaacgagaaacgcccuggacaaucuggugauguugcacacgucagaacauggcgggagggccuacaggcaugcaguggaggaacuaccagaaacaauggaaacacuccuacuccugggacucaugauccuguuaacagguggagcaaugcuuuucuugauaucggguaaagggauuggaaagacuucaauaggacucauuuguguaguugcuuccagcgguauguuauggauggcugauguuccacuccaauggaucgcgucggccauaguccuggaguuuuucaugaugguguuacuaauaccagaaccagaaaagcagagaacuccccaagacaaucaacucgcauaugucgugauaggcauacuuacguuggcugcaauaguagcagccaaugaaaugggacuguuggaaaccacaaagagagauuuaggaauguccaaagaaccagguguuguuucuccaaccagcuauuuggauguggacuugcacccagcaucagccuggacguuguacgcuguggccacaacaguaauaacaccaaugcugagacauaccauagagaauuccacagcaaaugugucccuagcagcuauagccaaccaggcagugguccugauggguuuagacaaaggauggccaauaucgaaaauggacuuaggcguaccacuauuggcacuggguuguuauucacaagugaauccacuaacucucacagcggcaguacuccugcuagucacgcauuaugcuaucauaggcccaggauugcaggcaaaagccacucgugaagcucaaaaaaggacagcugcuggaauaaugaagaauccaacaguggaugggauaaugacaauagaccuagacccuguaauauacgauucaaaauuugaaaaacaacuaggacagguuaugcuccugguucugugcgcaguucaacuuuuguuaaugagaacaucaugggcuuuuugugaagcucuaacccuagccacaggaccaauaacaacacucugggaaggaucaccugggaaguucuggaacaccacgauagccguuuccauggcgaacauauuuagagggagcuauuuggcaggagcugggcucgcuuuuucuaucaugaaaucaguuggaacaggaaagagagggacagggucacagggugaaaccuugggagaaaaguggaaaaagaaauugaaucaauuaucccggaaagaguuugaccuuuacaagaaauccggaaucacugaaguggauagaacagaagccaaagaaggguugaaaagaggagaaauaacacaccaugccguguccagaggcagcgcaaaacuucaaugguucguggagagaaacauggucauccccgaaggaagagucauagacuuaggcuguggaagaggaggcuggucauauuauugugcaggacugaaaaaaguuacagaagugcgaggauacacaaaaggcggcccaggacaugaagaaccaguaccuaugucuacauauggauggaacauagucaaguuaaugaguggaaaagauguguuuuaucuuccaccugaaaagugugauacucuauugugugacauuggagaauccucaccaagcccaacaguggaagaaagcagaaccauaagagucuugaagaugguugaaccauggcuaaaaaauaaccaguuuugcauuaaaguauugaacccuuacaugccgacugugauugagcacuuagaaagacuacaaaggaaacauggaggaaugcuugugagaaauccacucucacgaaacuccacgcaugaaauguacuggauaucuaauggcacaggcaauaucguuucuucugucaacaugguauccagauugcuacugaacagauucacaaugacacauaggagacccaccauagagaaagauguggauuuaggagcggggacccgacaugucaaugcggaaccagaaacacccaacauggaugucauuggggaaagaauaagaaggaucaaggaggagcauaguucaacauggcacuaugaugaugaaaauccuuauaaaacgugggcuuaccauggauccuaugaaguuaaggccacaggcucagccuccuccaugauaaauggagucgugaaacuccucacgaaaccaugggauguggugcccauggugacacagauggcaaugacggacacaaccccauucggccagcaaaggguuuuuaaagagaaaguggacaccaggacaccuagacccaugccaggaacaagaaagguuauggagaucacagcggaauggcuuuggagaacccugggaaggaacaaaagacccagauuauguacgagagaggaguucauaaaaaaggucagaaccaacgcagcuaugggcgccguuuuuacagaggagaaccaaugggacagugcuagagcugcuguugaggaugaagaauucuggaaacucguggacagagaacgugaacuccauaaauugggcaaguguggaagcugcguuuacaacaugaugggcaagagagagaagaaacuuggagaguuuggcaaagcaaaaggcaguagagccauaugguacaugugguugggagccagguaccuugaguucgaagcacucggauucuuaaaugaagaccauugguucucgcgugaaaacucucacaguggaguagaaggagaaggauugcauaaacugggauacaucuuaagagacauuuccaagauacccggaggagcuauguaugcugaugacacagcugguugggacacaagaauaacagaagaugaccugcacaaugaggaaaaaaucacacagcaaauggauccugaacauaggcaguuagcaaacgcuauauucaagcucacauaccaaaacaaaguggucaaaguucaacgaccaacuccaaagggcacgguaauggacaucauaucuaggaaagaccaaagaggcaguggacaggugggaacuuauggucugaacacauucaccaacauggaagcccaguuaaucagacaaauggaaggagaagguguguugucgaaggcugaccucgagaacccucaccugcuagagaagaaaguuacacaaugguuggaaacaaaaggaguggagagguuaaaaagaauggccaucagcggggaugauugcguggugaaaccaaucgaugacagguucgccaaugcccugcuugcccugaaugacaugggaaaaguuaggaaggacauaccucaauggcagccaucaaaaggauggcaugauuggcaacaggucccuuucugcucccaccacuuucaugaauugaucaugaaagauggaagaaaguugguaguucccugcagaccccaggaugaauuaaucgggagagcuagaaucucucaaggagcaggauggagccucagagaaacugcaugccuagggaaagccuacgcucaaaugugggcucucauguacuuucacagaagagaucuuagacuagcauccaacgccauauguucagcaguaccaguccauugggucccuacaagcagaacgacguggucuauucaugcucaccaucaguggaugaccacagaagauaugcuuacuguuuggaacaggguguggauagaggacaauccauggauggaggacaaaacuccagucacaaccugggaagauguuccauaucuagggaagagagaagaccaauggugcggaucacucauuggucucacuuccagagcaaccugggcccagaacauacuuacggcaauccaacaggugagaagccuuauaggcaaugaagaguuucuggacuacaugccuucaaugaagagauucaggaaggaggaggagucagagggagccauuugguaa

SEQ ID NO: 7781 - RNA, 9873 nt, Artificial Sequence
  derived and/or modified CDS sequence (wt) from DENV-3__AY876494__SS-prME
acaucgcucugucucaugaugauguuaccagcaacacuugcuuuccacuugacuucacgugauggagagccgcgcaugauuguggcgaagaaugaaagagggaaaucccuacuuuuuaagacagcuucuggaaucaacaugugcacacucauagccauggacuugggagagaugugugaugacacggucacuuacaaaugcccccucauugccgaaguggaaccugaagacauugacugcuggugcaaccuuacaucgacaugggugacauauggaacgugcaaucaagcuggggagcauagacgcgacaagagaucaguggcguuagcuccccaugucggcaugggacuggacacacgcacccaaaccuggaugucggcugaaggagcuuggagaccagucgagaagguagagacaugggcucuuaggcacccagguuucaccauacuagcucuauuucuugcucauuacauaggcacuucccugacccagaaagugguuauuuuuauacuacuaaugcuggucacuccauccaugacaaugagaugcgugggagugggaaacagagauuuuguggaaggucugucgggagcuacguggguugacguggugcucgagcacggugggugcgugacuaccauggcuaagaacaagccuacgcuggacauagagcuucagaagaccgaggccacccaacuggcgacccuaaggaaguuaugcauugagggaaaaauuaccaacguaacaacugacucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaacaugagaaccucaaauacacugucaucaucacagugcacacaggagaccaacaccaggugggaaaugacacgcagggagucacgguugagauaacaccccaggcaucaaccgcugaagcuaucuugccugaguauggaacccuuguguuagaaugcucaccacggacagguuuggauuucaaugaaaugauuuuauugacaaugaagaacaaagccuggaugguacauaggcaaugguucuuugaccuaccccuaccauggacaucaggagcuacaacagagacaccaacuuggaacaggaaagagcuucuuguaacauucaaaaaugcacaugcaaaaaagcaagaaguaguuguccuuggaucgcaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauaggguugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugaguuaaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucucuggagcaaugguguacuagagagugacaugaucaucccaaagagucuagcugguccuauuucacaacacaaccacaggcccggguacuacacccaaacggcaggaccuuggcacuugggaaaauuggagcuggacuucaacuauugugaaggaacaacaguagucaucacagaaaacugugggacaagaggcccaucauugagaacaacaacagugucagggaaguugauacacgaaugguguugccgcucgugcacacuuccucccuugcgauacaugggagaggacggcugcugguauggcauggagauuagaccuaucaaugagaaagaagagaacaugguaaagucuuuagucucagcagggaguggaaagguggacaacuuuacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggacgggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugccuauggcuggaccacuaguggccgggggcuuguugauagcgugcuaugucauaacuggcacgucagcagaccucaccguagaaaaagcagcagaugugacaugggaggaagaggcugagcaaacaggagugucccacaauuugaugaucacaguugaugaugauggaacaaugagaauaaaggaugaugagacugagaacaucccuacagugcucuuaaaaacagcauuacuaauaguuucaggcaucuuuccauacuccauacccgccacacuguuggucuggcauacuuggcaaaagcaaacccaaagaucuggcguucuaugggacguacccagccccccagaaacacagaaagcagaacuggaagagggggucuauaggaucaaacaacaaggaauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagugcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguagugggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugagauggaagaagcacugaaaggacucccaauaagguaucaaacaacugcaacaaaaucugaacacacaggaagggagauuguugaucuaaugugccacgcaacguucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugccgaagccuuuccucagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcggaaaaauggaaaaaaggucauccaacuuaguaggaagacuuuugauacagaauaucaaaagaccagacugaaugauugggacuucguggugacaacagacauuucagaaaugggagcuaacuuuaaagcagauagagugauugacccaagaagaugucucaagccaguaauuuugacagauggacccgagcgggugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggcgaguccaggaagaccuucguggaacucaugaggaggggugaccucccaguuuggcuagcccauaaaguagcaucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuacucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacagagaacuccccaagacaaccaacuugcauaugucgugauaggcauacuuacacuggcugcgauaguagcagccaaugaaaugggauuauuggaaaccacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcgugccgcuacuggcacugggcugcuauucacaagugaacccacugacucucacagcggcaguacuucugcuaguuacacauuaugccauuauagguccaggauugcaggcuaaagccacucgugaagcucaaaaaaggacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccuauaacaacacucugggaaggaucaccuggaaaguuuuggaacaccacgauagcuguuuccauggcuaacaucuuuagagggagcuacuuagcaggagcugggcuugcuuuuucuaucaugaaaucaguuggaacaggaaagagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauaguuaagcuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacaucgucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggauguggugcccauggugacacagauggcaaugacagauacaacuccauuugggcagcaaagaguuuucaaagagaaaguggacaccaggacacccaggcccaugccagggacaagaaagguuauggagaucacggcggaauggcuuuggagaacccugggaaggaacaaaagacccagauugugcacaagggaagaguucacaaaaaaggucagaaccaacgcggcuaugggagcuguuuucacagaggagaaccaaugggauagugcgagagcugcuguugaggacgaggaauucuggaacuugugggacagagaacgugaacuccacaaauuaggcaaguguggaagcugcgucuacaacaugaugggcaagagggagaagaaacuuggagaguuuggcaaagcaaaaggcaguagagcuauaugguacaugugguugggagccagguaccuugaguucgaagcacucgguuuuuuaaaugaagaccacugguucucgcgugaaaacucuuacaguggaguagaaggagaaggacugcacaagcugggauacauuuuaagagacauuucuaagauacccggaggagcuauguaugcugaugacacagcugguugggacacaagaauaacagaagaugaccugcacaaugaggaaaaaaucacacagcaaauggauccugaacacagacaauuagcgaacgccauauuuaagcucacauaccaaaacaaaguggucaaaguucaacgaccaacuccaaaaggcacgguaauggacaucauaucuaggaaagaccaaagaggcaguggacagguggggacuuauggucugaacacauucaccaacauggaagcucaguuagucagacagauggaaggagaaggcguguugucgaaggcagaccucgagaacccucaucugcuagagaagaaaaucaccccaugguuggaacccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucaucggucucacuuccagaucaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7782 - RNA, 9873 nt, Artificial Sequence
  derived and/or modified CDS sequence (wt) from DENV-3__AY923865__SS-prME
acaucgcucugucucaugaugauguuaccagcaacacuugcuuuccacuugacuucacgcgauggagagccgcgcaugauuguggggaagaaugaaagagggaaaucccuacuuuuuaagacagcuucuggaaucaacaugugcacacucauagcuauggacuugggagagaugugugaugacacggucacuuauaaaugcccccucauugccgaaguggaaccugaagacauugacugcuggugcaaccuuacaucgacaugggugacuuauggaacgugcaaucaagcuggggagcacagacgcgacaagagaucaguggcguuagcuccccaugucggcaugggacuggacacacguacccaaaccuggaugucggcugaaggagcuuggagacaagucgagaagguagagacaugggcucuuaggcacccagguuucaccauacuagcucuauuucuugcccauuacauaggcacuucccugacccagaaagugguuauuuuuauacuacuaaugcuggucacuccauccaugacaaugagaugcgugggaguaggaaacagagauuuuguggaaggucugucaggagcuacguggguugauguggugcucgagcacggugggugugugaccaccauggcuaagaacaagccuacgcuggacauagagcuucagaagaccgaggccacccaacuggcgacccuaaggaaguuaugcauugagggaaaaauuaccaacauaacaacuggcucaagguguccuacccagggggaagcgauuuuaccugaggagcaggaccagaacuacguauguaagcacacauacguggauagagguuggggaaacgguugugguuuguuuggaaaaggaagcuuggugacaugcgcgaaauuucaaugucuagaaccaauagagggaaaaguggugcaauaugagaaccucaaauacacugucaucaucacagugcacacaggagaccaaccccaggugggaaaugacacgcagggagucacgguugagauaacaccccaggcaucaaccguugaagcugucuugcuugaauauggaacccuugggcuaaaaugcucaccacggacaggcuuggauuucaaugaaaugauuuuauugacaaugaagaccaaagccuggaugguacauaggcaaugguucuuugaccuaccccuaccauggacaucaggagcuacaacagagacaccaacuuggaacaggaaagagcuucuuguaacauucaaaaaugcacaugcgaaaaagcaagaaguaguuguccuuggaucacaagagggagcaaugcacacagcgcugacaggagcuacagagauucaaaacucaggagguacaagcauuuuugcggggcacuugaaauguagacuuaagauggacaaauuggaacucaaggggaugagcuaugcaaugugcuugaauaccuuuguguugaagaaagaagucuccgaaacgcagcaugggacaauacucauuaagguugaguacaaaggggaagaugcaccuugcaagauuccuuucuccacagaggauggacaagggaaagcccacaaugguagacugaucacagccaacccaguggugaccaagaaggaggagccugucaacauugaggcugaaccuccuuuuggggaaagcaacauagugauuggaauuggagacaaagccuugaaaauuaacugguacaagaagggaagcucgauugggaagauguucgaggccacugccagaggugcaaggcgcauggccaucuugggagacacagccugggacuuugguucagugggugguguucuaaauucauuagggaaaauggugcaccaaauauucggaagugcuuacacagcccuguuuagcggagucucauggauaaugaaaauuggaauagguguccucuuaaccuggauagggcugaauucaaaaaacacuuccaugucauuuucaugcauugugauaggaauuauuacacucuaucugggagccgugguacaagcugacauggggugugucauaaacuggaaaggaaaagaacucaaauguggaaguggaauuuucgucacuaaugagguccacaccuggacagagcaauacaaauuucaagcagacuccccuaaaagacuggcgacagccaucgcaggcgcuugggaaaauggagucuguggaaucaggucaacaaccagaauggagaaucuauuguggaagcaaauagccaaugagcugaacuacauauuaugggaaaacaacaucaaauuaacgguaguugugggcgacauaauuggggucuuagagcaagggaaaagaacacuaacaccacagcccauggagcuaaaauauucauggaaaacauggggaaaggcaaaaauagugacagcugaaacacaaaauuccucuuucauaauagaugggccaaacacaccggaguguccaagugccucaagagcauggaaugugugggagguggaagauuacggguuuggagucuucacaaccaacauauggcugaaacuccgagagguguacacccaaucaugugaccauaggcuaaugucggcagccaucaaagaugagagggccgugcaugccgacaugggcuauuggauagaaagccaaaagaauggaaguuggaagcuagaaaaagcauccuucauagaggugaaaaccuguacuuggccaaaaucacacacucuuuggagcaaugguguacuagagagugacaugaucaucccaaagagucuagcugguccuauuucacaacacaaccacaggcccggguaccacacccaaacggcaggaccuuggcacuugggaaaauuggagcuggacuucaacuauugugaaggaacaacaguagucaucacagaaaacugugggacaagaggcccaucauugagaacaacaacagugucagggaagcugauacacgaaugguguugccgcucgugcacacuuccucccuugcgauacaugggagaggacggcugcugguauggcauggaaauuagaccuaucaaugagaaagaagagaacaugguaaaaucuuuagucucagcagggaguggaaaaguggacaacuucacaaugggaguccuguguuuggcaauccucuucgaagaggugaugagaggaaaauuugggaaaaaacacaugauugcagggguucucuucacguuugugcuccuucucucagggcaaauaacauggagagauauggcacacacacucauaaugauuggguccaacgcuucugacaggaugggaaugggcguuaccuaccuagcuuuaauugcaacauucaaaauccagccauucuuggcuuugggauucuuccugaggaaauugacaucuagagaaaauuugcuguugggaguuggguuggccauggcaacaacguuacaacugccagaggacauugaacaaauggcgaauggaauugcucuggggcucaugacucuaaaacugauaacacaauuugagacauaucaguuguggacggcauuagucuccuuaacauguucaaacacaauuuucacguugacuguugccuggagaacagccaccuugauucuggccggaguuucgcuuuugccacugugccagucuucgagcaugaggaaaacagauuggcucccaaugacuguggcagcuaugggaguuccacccuuaccacuuuuuaucuucagcuugaaggacacacccaaaaggaggagcuggccacugaaugagggagugauggcuguugggcuugugagcauucuagcuaguucucuccuuaggaaugaugugcccauggcuggaccacuaguggccgggggcuuguugauagcgugcuaugucauaacuggcacgucagcagaccucacuguagaaaaagcagcagauguaacaugggaggaagaggcugagcaaacaggagugucccacaauuugaugaucacaguugaugaugauggaacaaugagaauaaaggaugaugagacugagaacauccuaacagugcucuuaaaaacagcauuacuaauaguaucaggcaucuuuccauacuccauacccgccacacuguuggucuggcauacuuggcaaaagcaaacccaaagaucuggcguucuaugggauguacccagccccccagaaacacagaaagcagaacuggaagagggggucuauaggaucaaacaacaaggcauuuuugggaaaacccaaguggggguuggagugcagaaagaaggagucuuccacaccauguggcacgucacaagaggggcaguguugacgcacaaugggaaaagacuggaaccaaacugggccagcgugaaaaaagaucugauuucauacggaggaggauggagauugagcgcacaauggcaaaagggagaggaggugcagguuauugccguagagccugggaagaacccaaaaaacuuucaaaccaugccgggcauuuuucagacaacaacgggggaaauaggagcaauugcacuagacuucaagccuggaacuucaggaucuccuaucauaaacagagagggaaagguaguaggacuguauggcaauggagugguuacaaaaaaugguggcuacgucaguggaauagcgcaaacaaaugcagaaccagacggaccgacaccggaauuggaagaagaaauguucaaaaagcgaaaucuaaccauaauggaucuucauccugggucaggaaagacgcggaaauaucuuccagccaucgucagagaagcaaucaagagacgcuuaagaacucuaauuuuggcaccaacaagagugguugcagcugaaauggaagaagcacugaaaggacucccaauaagguaucaaacaacugcaacaaaaucugaacacacaggaagggagauuguugaucuaaugugccacgcaacauucacaaugcgcuugcuaucaccagucaggguuccaaauuacaauuugauaauaauggaugaggcccauuucacagauccagccaguauagcggcuagaggguacauaucaacucguguaggaaugggagaggcagcugcaauuuucaugacagcaacacccccuggaacugcugaagccuuuccccagagcaacgcuccaauucaagaugaagaaagggauauuccggaacgcucauggaauucaggcaaugaauggauuaccgacuuuguugggaagacggugugguuugucccuagcaucaaagccggaaaugacauagcaaacugccugcgaaaaaauggaaaaaaggucauccaacuuaguaggaagacuuuugauacagaauaucagaagaccagacugaaugauugggacuuccuggugacaacagacauuucagaaaugggagcuaacuuuaaagcagauagagugauugacccaagaagaugucucaagccaguaauuuugacagauggacccgagcgagugauccuggcuggaccaaugccagucaccgcagcgagcgcugcgcaaaggagagggagaguuggcaggaacccacaaaaagaaaaugaccaguacauauucacgggccagccucucaacaaugacgaagaccaugcucacuggacagaagcaaaaaugcugcuagacaacaucaacacaccagaagggaucauaccagcucucuuugaaccagagagggagaagucagccgcuauagacggugaauaccgccugaagggugaguccaggaagaccuucguggaacucaugaggaggggugaccucccaguuuggcuagcccauaaaguagccucagaagggaucaaauacacagauagaaaauggugcuuugauggagaacguaauaaucaaauuuuagaggagaacauggauguggaaaucuggacaaaggaaggagaaaggaaaaaauugagaccuagguggcuugaugcccgcacuuauucagaucccuuagcacucaaggaauucaaggauuuugcagcuggcagaaagucaaucgcccuugaucuugugacagaaauaggaagagugccuucacacuuagcccacagaacgagaaacgcccuggacaauuuggugaugcugcacacgucagaacauggcgguagggccuacaggcaugcaguggaggaacuaccagaaacaauggaaacacuccuacucuugggacucaugaucuuauuaacagguggagcaaugcuuuucuugauaucagguaaagggauuggaaagacuucaauaggacucauuuguguuauuguuuccaguggcauguuauggauggcugaugucccacuucaauggaucgcgucggcuauaguccuggaauuuuucaugaugguguugcucauaccagaaccagaaaaacaaagaacuccccaagacaaccaacucgcauaugucgugauaggcauacuuacacuggcugcgauaguagcagcuaaugaaaugggauuacuggaaacuacaaagagagauuuaggaaugucuaaagaaccagguguuguuucuccaaccagcuauuuagauguagacuugcacccagcaucagccuggacauuguacgccguggccacaacaguaauaacaccaauguugagacauaccauagagaauuccacagcaaaugugucccuggcagccauagcuaaccaggcagugguccugauggguuuagacaaaggauggccaauaucgaaaauggaccuaggcguaccgcuacuggcacugggcugcuauucacaagugaacccacugacucucacagcggcaguacuucugcuagucacacauuaugccauuauagguccaggauugcaggcuaaagccacucgugaagcucaaaaaagaacagcugcuggaauaaugaagaauccaacgguggaugggauaaugacaauagaccuagauccuguaauauacgauucaaaauucgaaaagcaacuaggacaggucaugcuccugguucugugugcaguucaacuuuuguuaaugagaacaucaugggccuugugugaagcucuaacccuagccacaggaccaauaacaacacucugggaaggaucaccuggaaaguuuuggaacaccacgauagcuguuuccauggcuaacaucuuuagagggagcuacuuagcaggaacugggcuugcuuuuucuaucaugaaaucaguuggaacaggaaggagaggaacggggucacaaggcgaaaccuuaggagaaaaguggaaaaagaaauuaaaucaguuaucccggaaagaguuugaccuuuacaagaaaucuggaaucacugaaguggauagaacagaagccaaagaaggguugaaaagaggagaaacaacacaucaugccguguccagaggcagcgcaaaacuucaaugguucguggagaggaacauggucauucccgaaggaagagucauagacuuaggcuguggaagaggaggcuggucauauuacugcgcaggacugaaaaaaguuacagaagugcgaggauacacaaaaggcggcccaggacacgaagaaccaguaccuaugucuacauacggauggaacauagucaaguuaaugaguggaaaggacguguuuuaucuuccaccugaaaagugugacacccuauugugugacauuggagaaucuucaccaagcccaacaguggaagaaagcagaacuauaagaguuuugaagaugguugagccauggcuaaaaaacaaccaguuuugcauuaaaguauuaaacccuuacaugccaacugugauugagcaccuagaaagacuacaaagaaaauauggaggaaugcuugugagaaacccacucucacgaaacuccacgcaugaaauguacuggauauccaaugguaccggcaacauugucucuucagucaacaugguauccagauugcuacugaacagauuuacgaugacacacaggagacccaccauagagaaagauguggauuugggagcaggaacucgacaugucaaugcggaaccagaaacacccaacauggacgucauuggagaaagaauaaaaaggaucaaggaggagcauaguucaacauggcacuaugaugaugaaaauccuuacaaaacgugggcuuaccauggauccuaugaagucaaagccacaggcucagccuccuccaugauaaauggagucgugaaacuccucacaaaaccaugggaugugguucccauggugacacagauggcaaugacagacacaacuccauuugggcagcaaagaguuuucaaagagaaaguggacaccaggacacccaggcccaugccagggacaagaaagguuauggagauuacagcggaauggcuuuggagaacccugggaaggaacaaaaaacccagauugugcacaagggaagaguucacaaaaaaggucagaaccaacgcggcuaugggagcuguuuucacagaggagaaccaaugggauagugcgagagcugcuguugaggacgaggaauucuggaaacuuguggacagagaacgugaacuccacaaauugggcaaguguggaagcugcgucuacaacaugaugggcaagagagagaagaaacuuggagaguuuggcaaagcaaaaggcaguagagcuauaugguacaugugguugggagccagguaccuugaguucgaagcacucggauuuuuaaaugaagaccacugguucucgcgugaaaacucuuacaguggaguagaaggagaaggacugcacaagcugggauacauuuuaagagacauuucuaagauacccggaggagccauguaugcugaugacacagcugguugggacacaagaauaacagaagaugaccugcacaaugaggaaaaaaucacacagcaaauggacccugaacacagacaauuagcgaacgccauauuuaagcucacauaccaaaacaaaguggucaaaguccaacgaccaacuccaaaaggcacgguaauggacaucauaucuaggaaagaccaaagaggcaguggacagguggggacuuauggucugaacacauucaccaacauggaagcccaguuagucagacagauggaaggagaaggcguguugucgaaggcagaccucgagaacccucaucugcuagagaagaaaaucacacaaugguuggaaaccaaaggaguggagagauuaaaaagaauggccaucagcggggaugauugcguggugaaaccgaucgaugacagguuugccaaugcccugcuugcccugaacgacaugggaaagguuaggaaggacauaccucaauggcagccaucaaagggguggcaugauuggcaacaggucccuuucugcucccaccacuuucaugaacugaucaugaaagauggaagaaaguuggugguucccugcagaccccaggacgaacuaauaggaagggcgagaauuucucaaggagcaggauggagccuuaaagaaacugcaugucuagggaaagccuacgcucaaauguggagucucauguauuuucacagaagagaucuuagacuagcauccaacgccauuuguucagcaguaccaguccauugggucccuacaagcagaacgacauggucuauucacgcucaccaucaguggaugacuacagaagacaugcuuacugucuggaacaggguguggauagaggacaauccauggauggaagacaaaacuccagucacaacuugggaagauguuccauaccuagggaagagagaagaucaauggugcggaucacucauuggucucacuuccagagcaaccugggcccagaacauacucacagcaauccaacaggugagaagccuuauaggcgaugaagaauuucuggacuacaugccuucgaugaagagauucaggaaggaggaggagucagagggagccauuugguaa

SEQ ID NO: 7783 - RNA, 9867 nt, Artificial Sequence
  derived and/or modified CDS sequence (wt) from DENV-4__KR922405__SS-prME
ucaacaauaacauugcugugcuugauucccacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugcgaggacaccgucacguauaaaugccccuuacuggucaauaccgaacccgaggacauugauugcuggugcaaucucacgucugccuggguuauguaugggacaugcacccaaaguggagaacgaaggcgagagaagcgcucaguagcucuaacaccacauucaggaaugggauuggaaacaagggcugaaacauggaugucaucggaaggagcuuggaaacacgcccagaggguagagaguuggauacucagaaacccaggauucgcgcucuuggcaggguuuauggccuacaugaucgggcaaacaggaauccagcgaacagucuucuucauucuaaugauguuggucgccccaucuuacggaaugcgaugcgugggaguagggaacagagacuuuguagaaggagucucagguggagcaugggucgaucuggugcuggaacauggaggaugugucacaaccauggcccagggaaagccaaccuuggauuuugaacugaucaagacaacagccaaggaaguggcccuguuaagaaccuauugcauugaagcuuccauaucaaacauaaccacggcaacaagauguccaacgcaaggagagccuuaccucaaagaggaacaagaucaacaguacaucugccggagagacaugguagauagaggguggggcaacggcuguggcuuguuugggaagggaggaguugugacaugugcgaaguucucaugcuuggggaagauaacgggcaacuuaguucaaauugagaaccuugaauacacagugguuguaacaguccacaauggagacacccacgcuguaggaaaugacacaucuaaccauggagugacagccacgauaacccccaggucaccaucgguugaaguuaaauuaccggacuauggagaauugacacuugacugugaaccuagguccggaauugacuucaaugagaugauucugaugaaaaugaaaacgaaaacguggcucgugcacaagcaaugguuuuuggaucuaccucuaccauggacaacaggagcagacacguuagaaguucacuggaaucacaaagagagaauggugacauucaagguuccucaugccaagagacaggaugugacagugcuaggaucucaggaaggagccaugcauucagcccucgccggagccacagaaguggauuccggugauggaaaccauauguuugcaggacacuuaaaguguaaaguucguauggaaaaguugaggaucaagggaaugucauacacgaugugcucaggaaaguucucaauugauaaagagauggcagaaacacagcauggaacaacagugguaaaggucaaguaugaagguacuggagcuccauguaaaguucccauagagauaagagaugugaacaaggaaaaagugguugggcgcaucaucucauccaccccuuuugcugagaacaccaacagugugaccaauauagaauuggaaccuccuuuuggggauagcuacauagugauaggugugggagacagugcauuaacacuccauugguucaggaaagggagcuccauuggcaagauguuugaguccacauacagaggugcaaagcgcauggccauucuaggugaaacagcuugggauuuugguuccguugguggacugcuuacgucauugggaaaggcuguacaccagguuuuuggcaguguguacacaacuauguuuggaggagucucauggauggucagaauccuaaucggacucuuaguguuguggauugguacgaauucaagaaacacuucaauggcuaugucgugcauagcuguuggaggaaucacccuguuuuugggcuucacaguccaugcagacauggguuguguggugucauggagugggaaagaguugaaauguggaagcggaaucuuuguaauugacaacgugcacacuuggacagaacaguacaaauuucaaccagagucuccagcgcgacuggcgucggcaauacugaaugcccacaaagaaggggucuguggaauuagaucaaccacgaggcuggaaaaugucauguggaagcaaauaaccaaugaguuaaacuauguucucugggaaggaggacaugaccucacuguaguggccggggaugugaaagggguguuguccaaaggcaagagagcacucgcaccuccagugaaugaccugaaauauucauggaagacaugggggaaagcgaagaucuuuacuccagaaacaagaaacagcacauuuuugguggacggaccagacaccuccgaaugccccaaugaacgaagagcauggaacuuucuugagguggaagacuauggauuuggcauguucacgaccaacauauggaugaaauuucgagaaggaaguucagaagugugugaccauaggcugaugucagcagcaaucaaagaccagaaagcugugcaugcugauaugggcuauuggauagagagcucaaaaaaccagaccuggcagauagaaaaggcaucccucauagaagugaaaacaugucuguggcccaagacccacacauuguggagcaauggagugcuggaaagccagaugcucaucccaaaagcauaugcaggcccuauuucacagcacaacuaucgccagggcuaugccacgcagaccgcgggcccauggcacuugggcaaauuggagauagacuuuggagaaugcccuggaacaacagucacuauacaagaggauugugaccauagaggcccaucuuugaggaccaccacugcaucuggaaaauuggucacgcaguggugcugccgcuccugcacgaugccucccuuaagauuuuuaggagaggauggaugcugguaugggauggaaaucaggcccuugaaugaaaaagaggagaacauggucaaaucacagguaucagccggacaggguacaucagagaccuuuucuauggggcuguugugccugacuuuguuuguggaagaaugcuugaggagaagagucaccaggaaacacaugauauugguuguggugaccacccuuugugccaucauuuuaggaggucucacauggauggacuuacugcgugcccuuaucaugcuaggagacaccaugucugguagaauggggggacagauucaucuagccaucauggcaguguucaagaugucaccaggauacguguuggguauauuucugaggaaacucaccucaagagagacagcacugaugguaauaggaauggccaugacaacggugcucucaauuccacaugaccuuauggaauuuauugauggaauaucauuaggguuaaucuuauuaaaaaugguaacacauuuugacaacacucaagugggaaccuuagcccuugccuugaccuucauaaaaucaacaaugccauuggucauggcuuggaggaccauaauggcuguguuguuuguggucacacucauuccucuauguaggacaagcugucuucaaaagcagucccauuggguggaaauaacagcacucauccugggagcccaggcucugccaguauaccuaaugacucucaugaaaggagccucaaaaagaucuuggccccuuaacgaggguauaauggcugugggcuuggucagucucuuaggaagcgcccuucuaaagaaugaugucccuuuagcuggcccaaugguggcaggaggcuuacuucuggcagccuacgugaugagcggcagcucagcagaccugucacuagagaaggcugccaaugugcagugggaugagauggcagacauaacaggcucaagcccaaucauagaagugaagcaggaugaagauggcucuuucuccauacgggacgucgaggaaaccaacaugauuacccuccuggugaaacuggcgcugauaacagugucaggucucuaccccuuggcaauuccagucacaaugacccuaugguacauguggcaagugaaaacacaaagaucaggagcccugugggacguucccucaccugcugccgcucagaaagcuacacugacugagggaguauacaggaucaugcaaagaggguuguuugggaaaacccagguuggaguagggauacacacggaagguguguuucauacaauguggcauguaacaagaggaucagugauuugccaugagagugggagacuggagccaucuugggcugacgucaggaacgacaugauaucauauggugggggauggaggcucggagacaaaugggacaaagaagaagauguucaaguucuagcuauagaaccaggaaaaaauccgaaacauguccaaacgaaacccggccuuuuuaaaacccuuacuggagaaauuggagcaguaacauuggacuucaaacccggaacauccgguucucccaucauuaacaggaaaggaaaagucaucggacucuacggaaaugggguaguuaccaaaucaggugauuacguuagugccauaacacaagcugaaagaauuggugagccagacuaugaaguggaugaggacauuuuccgaaagaaaagauuaacuauaauggauuuacaucccggagccggaaagacaaaaagaauccucccaucaauaguuagagaagccuuaaaaaggaggcugcgaaccuugauucuggcucccacgagagugguggcggccgaaauggaagaagcgcuacguggacugccaauccguuaucagaccccagcugugaaaucagaacacacaggaagagagaucguagaccucaugugucaugcaaccuuuacaacaagacuuuuaucaucaaccaggguuccaaauuacaaccucauagugauggaugaagcgcauuucacagacccuucuagcguugcagcuagaggauauaucucaaccaggguggaaaugggagaggcugcagcuaucuuuaugacugcaaccccuccuggaacgacagaucccuucccccagagcaacagcccaauagaagacaucgagagagaaaucccagaaaggucauggaacacaggguuugacuggauaacggacuaccaagggaaaacugugugguuuguucccagcauaaaggcuggaaaugacauugcaaauugcuugagaaaaucgggaaagaaggucauccaauugagcaggaaaaccuucgacacagaguauccaaaaacgaaacucacggacugggauuuugugguuaccacagacauaucugaaaugggggccaauuuuagagcugggagagugauagaccccaggagaugccucaagccaguuaucuuaacugaugggccggagagaguuauuuuagcuggucccauuccagugacuccagcaagcgcugcucagagaagagggcgaauagguaggaacccagcacaagaagaugaccaguaugucuucuccggagacccacuaaggaaugaugaggaucaugcccacuggacugaagcaaagaugcuucuugauaauaucuacacuccagaagggaucaucccaacacuguuugguccagaaagggaaaaaacccaagccauugacggagaguuccgccucagaggggaacaaaggaagaccuuuguagaauuaaugaggaggggagaccuuccgguguggcugagcuacaagguagcuucugcugguaucucuuacaaagaccgggaauggugcuucacgggggaaaggaauaaccaaauuuuggaagaaaacauggagguugaaauuuggacuagagagggagagaagaaaaaacucaggccaaaaugguuagaugcacguguuuacgcugaucccauggcuuugaaggauuucaaggaguuugccaguggaagaaagaguauaacccucgacaucuugacagaaauugccaguuugccaauguaccuuuccuccagggcuaagcucgcccuugacaacauagucaugcuccauacaacagaaagaggagggaaggccuaccaacacgcucugaacgaacucccagagucacuagaaacacucaugcuuguagcuuuauuaggagccaugacagcaggcaucuuccuauucuucaugcaaggaaaaggaauaggaaaauugucaauggguuugauagccauugcgguagcuaguggcuugcucuggguggcagaaauccagccccaauggauagcggccucaaucauauuggaguuuuuucucauggugcuguugguaccagaaccagaaaaacaaaggaccccacaagacaaucaauugaucuacgucauauugaccauucucacuauuauugcucucguggcagccaaugagauggggcuaauugaaaaaacaaaaacggauuuuggguuuuaccaggugaaagcagaaaccaccauccuugauguggaucuaagaccagcuucagcauggacgcucuaugcaguagcuaccacuaucuugacucccaugcugaggcacaccauagaaaacacgucugcaaacuuauccuuggcggccauugccaaccaagcagccgucuugauggggcuuggaaaaggauggccgcuccacagaauggaccucggugugccgcuauuggcaaugggaugcuauucccaagugaacccaacaacuuuaacagcauccuuagucaugcuucugguccauuaugcaauaauagguccaggauugcaggccaaagccacaagagaggcucaaaaaaggacagcugcugggaucaugaagaaucccacaguggacgggauaacaguuauagaucuagaaccaauauccuaugacccaaaauuugagaaacagcuagggcaagucaugcuacuaguucugugcgcuggacagcuacucuugaugagaacaacaugggccuuuugugaaguccugacuuuggccacaggaccaaucuugaccuugugggaaggcaacccgggaagguuuuggaacacgacaauagccguguccacugccaacauuuucaggggaagcuacuuggcgggagcuggauuggccuuuucgcucauaaagaaugcacaaacccccaggaggggaacugggaccacaggagagacacugggagaaaaauggaagagacagcuaaacucgcuagauaggaaggaguuugaagaguacaaaagaaguggaauacuagaaguggacaggacugaagccaagucugcccuaaaagauggguccaaaaucaaguucgcaguguccagagggaccagcaagauuagauggauuguugaaagagggaugguaaagccaaaagggaaaguuguggaucuugguugcggaagaggaggauggucguacuauauggcgacacucaagaacgugaccgaggugaaaggguacacaaaaggagguccaggacaugaggaaccgguucccauggcgaccuauggcuggaacuuggucaaacuccauucagggguugacguguucuacaaacccacugagcaaguggacacucugcucugugauauuggggagucauccucuaauccgaccauagaggaaggaagaacauuacgaguuuuaaaaaugguggagccauggcucucuucaaaaccugaauucugcaucaaaguccucaauccuuacaugccaacagucauagaggagcuggagaaacugcagagacgacaugguggaagccuugucagaugcccacuauccaggaauuccacucaugagauguauugggugucaggugugucaggaaacaucgugaguucugugaacacaacaucaaagauguuguugaacagauuuaccacaaggcacaggaaacccacuuaugagaaggacgcagaccuuggagcaggaacgagaagugucuccaccgaaacagaaaaaccagacaugacaaucaucgggagaagacuccagcgauugcaagaggagcacaaagaaacuuggcacuaugaucaugaaaauccauacagaaccugggcguaucauggaagcuaugaagcuccuucgacaggcucagcauccuccauggugaacgggguaguuaaacugcugacaaaacccugggacgugguuccaauggugacccaguuggcuaugacagauacuacccccuuugggcaacagagaguguucaaggagaagguugacaccagaacaccgcagccaaaacccgguacacgaguaaucaugaccacgacagccaacuggcuguggacucuccucgggaggaagaaaaaucccagacugugcacaagggaagaauucaucucaaaagucaggucaaaugcagccauaggcgcagucuuucaggaagaacagggauggacaucagccagugaagcagugaaugacagccgauuuugggaacugguugacaaagaaagggcucugcaccaggaagggaaaugugaaucaugugucuauaacaugaugggaaaacgugaaaagaaacuaggagaauuuggcagagccaaggggagccgagcaaucugguacauguggcugggagcgcgguuucuggaauuugaagcccugggcuuuuugaaugaagaucacugguuuggcagggaaaacucauggaguggaguggaaggggaaggucugcauagguugggauacaucuuggaggacauagacaagaaggauggagaucugauauaugcugaugacacagcaggcugggacacaagaaucacugaagaugaccuucugaaugaagagcugaucacggaacagauggccccucaucauaaaauccuagcuaaagccauuuucaaacuaacuuaucaaaacaaaguagugaaaguccucagaccuacaccgaaaggagcagugauggacauuauauccaggaaagaucaaagagguaguggacagguuggaacauaugguuugaacacauucaccaacauggaaguacaacucauccgccaaauggaagcugaaggagucauuacacaagaugacaugcauaacccaaaaggguugaaggaaagaguugagaaauggcugaaagaguguggugucgacagguuaaagaggauggcaauuaguggagaugauugugugguaaagccucuagaugagagguucagcacuucccuccucuuuuugaacgacaugggaaaggugaggaaagacauuccgcaaugggaaccauccaagggauggaaaaacuggcaagagguuccuuuuugcucccaccauuuucacaagaucuuuaugaaggauggccguucacuagucguuccauguagaaaccaggaugaacugauagggagagccagaaucucgcaaggggcuggauggaguuuaagagaaacggccugucugggcaaagcuuacgcccagauguggucgcucauguacuuucauagaagggaccuacguuuagccucuauggcuauaugcucagcagucccaacggaaugguucccaacaagcagaacaacauggucaauccacgcucaucaucaguggaugacuacugaagauaugcuaaaaguguggaacagaguguggauagaagacaacccuaauaugauugacaaaacuccaguucacucgugggaagacauacccuaccuagggaaaagagaggauuugugguguggauccuugauuggacucucuuccagggccaccugggcuaagaacauucacacagccauaacccaggucaggaaccugaucgggaaagaggaauauguggauuacaugccagccaugagaagauacagcgcucauuucgagagugaaggaguucuguaa

SEQ ID NO: 7784 - RNA, 9867 nt, Artificial Sequence
  derived and/or modified CDS sequence (wt) from DENV-4__KP188557__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccugguguuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguggauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaauugccggacuauggagaacuaacacucgauugugaaccuaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaagaaucuucaccccugaagcaagaaacaacacauuuuuaauagacggaccagauaccucugaaugccccaaugaacgaagagcauggaauucuuuugagguggaagacuauggguuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuacgcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuggagaaggccgcuaaugugcggugggaugaaauggcagacauaacaggcucaaguccaaucauagaagugaagcaagaugaggauggcucuuucuccauacgggacguugaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuuuaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugcgccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuggaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauuaucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuagagaaacugcagagaaaacauggugggaaccuugucagaugcccgcuguccaggaacuccacccaugagauguacugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauuggaagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcucagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7785 - RNA, 9867 nt, Artificial Sequence
  derived and/or modified CDS sequence (wt) from DENV-4__KP188558__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacgauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuagaucugccucuuccauggacgacaggagcagauacaucagagguucacuggaauuacaaagagagaauggugacauucaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaauaucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccaggugaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcugccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacgcugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaaaauguuguugaacagguucacaacaaggcacaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaagggcugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7786 - RNA, 9867 nt, Artificial Sequence
  derived and/or modified CDS sequence (wt) from DENV-4__KP188563__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcacucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuauggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcauugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacagagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccagugggaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggagcugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguucggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7787 - RNA, 9867 nt, Artificial Sequence
  derived and/or modified CDS sequence (wt) from DENV-4__KP188564__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaauaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccucauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauagcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugucguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucacgccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauauacgauguguucaggaaaguuuucaauugacaaagagauggcagaaacacagcaugggacaacaguggugaaaaucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaucagguuuuuggaaguguguauacaaccauguuuggaggagucucauggaugauuagaauccuaauuggguucuuaguguuguggauuggcacgaacucaaggaauacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagauuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggaguguuggagagccagaugcuuauuccaaaaucauaugcaggcccuuuuucacagcacaauuaccgccagggcuaugcuacgcaaaccguggguccauggcacuuaggcaaacuagagauagacuuuggagagugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuauugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggauaccaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucucaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaagaaucccaaacauguccaaacgaaaccuggccuuuucaagacccuaacuggagaaauuggagcaguaacauuggauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaaccauaauggacuuacacccuggagcuggaaagacaaaaagaauucuuccaucaauagugagagaagccuuaaaaaggaggcugcgaacuuugauuuuggcucccacgagaguaguggcggcugagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgacuaggguggaaaugggagaggcagcagccaucuucaugaccgcaaccccucccggagcaacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauugucugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaaaccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuuaaugagaacaacaugggcuuucugugaagucuugacuuuggcuacaggaccaaccuugaccuugugggaaggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagaucagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuauaaacccacagagcaaguggacacucugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccaaugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaagaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuucacagaagggaucugcguuuagccuccauggcuauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7788 - RNA, 9867 nt, Artificial Sequence
  derived and/or modified CDS sequence (wt) from DENV-4__JN983813__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaaccacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauauugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauuugggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacaucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguggaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucauccuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7789 - RNA, 9867 nt, Artificial Sequence
  derived and/or modified CDS sequence (wt) from DENV-4__KF041260__SS-prME
ucaacaauaacauuguugugcuugauucccaccguaauggcguuucacuugucaacgagagauggcgaaccccuuaugauaguggcgaaacacgaaagggggagaccucucuuguuuaagacaacagaaggaaucaacaagugcacucucauugcuauggaccugggugaaaugugcgaggacaccguuacguauaaaugcccucugcugguuaacacugaaccugaagacauugauugcugguguaaucucacgucugccugggucauguaugggacaugcacccaaaguggggaacggagacgagagaagcgcucaguagcucuaacaccacauucaggaaugggacuggaaacaagggcugaaacauggaugucaucggaaggagcuuggaaacacgcccagaggguagagaguuggauacucagaaacccaggauucgcgcucuuggcaggauuuauggccuauaugauugggcaaacaggaauccagcggacagucuucuuuauuuuaaugaugcuggucgcuccauccuacggaaugcgauguguaggaguggggaacagagacuuuguggaaggagucucagguggagcaugggucgaucuggugcuagaacauggaggaugugucacaaccauggcccagggaaaaccaaccuuggauuuugaacugaucaagacaacggcuaaggaaguggcucuguuaagaaccuauugcauugaagccuccauaucaaacauaaccacggcaacaagauguccaacgcaaggagagcccuaccucaaagaggaacaagaucaacaguacaucugccggagagacgugguagacagaggguggggcaauggcuguggccuguuugggaaaggaggaguugugacaugugcgaaguuuucaugcucggggaagauaacaggcaacuuaauccaaauugagaaccuagaauacacagugguuguaacaguccacaauggagacacccaugcaguaggaaaugacacauccaaccacggagugacagccacgguaacccccaggucaccaucgguagaaguugaauugccggacuauggagaauugacacucgauugugagcccagguccggaauugacuuuaaugagaugauucugaugaaaaugaauaagaaaacguggcuugugcacaagcaaugguuuuuggaucuaccucuaccauggacagcaggagcagacacgucagaaguucauuggaaucacaaagaaagaauggugacguuuaaggucccucaugccaagagacaggaugugacagugcuaggaucucaggaaggagccaugcauucagcccucaccggagccacagaaguagauuccggugauggaaaccacauguuugcaggacauuugaaaugcaaaguucgcauggagaaauugaggaucaagggaaugucauacacgaugugcucaggaaaguucucaauugauaaagagauggcagaaacacagcaugggacaacagugguaaaagucaaguaugagggugcuggagcuccaugcaaaguucccauagagauaagagaugugaacaaggaaaaagugguugggcguaucaucucaucuacuccuuuugcugagaauaccaacagugugaccaauauagaauuggaaccccccuuuggggauagcuacauaguaauagguguaggagacagcgcacugacacuucauugguucaggaaagggaguuccaucgguaagauguuugaguccacauacagaggcgcaaagcgcauggccauucuaggugaaacagcuugggauuuugguucuguugguggacugcucacaucauugggaaaggcuguacaccaaguuuuugguaguguguauacaacuauguucggaggagucucauggaugguuagaauucuaauuggguucuuaguguuguggauuggcacgaauucaagaaacaccucaauggcaaugucaugcauagcuguuggagggauuacuuuguuucuggguuucacaguccaugcagacauggguugugcggugucauggagugggaaagaauugaaguguggaagcggaaucuuuauaauugacaacgugcacacuuggacagaacaguacaaguuccaaccagagucaccagcgagacuagcgucugcaauacugaaugcccacaaagauggggucuguggaauuagaucaaccacgagguuggaaaaugucauguggaagcaaauaaccaaugaguuaaacuaugugcucugggaaggaggacaugaccucacuguaguggccggggacgugaaagggguguuauccaaaggcaagagagcauuagcaccuccagugaaugauuugaaauauucauggaagacauggggaaaagcaaagaucuucacuccagagacaagaaacagcacauuuuuaauagacggaccagacacuuccgaaugucccaaugaacgaagagcauggaauuuucuugagguagaagacuauggauuuggcauguucacgaccaacauauggaugaaauuucgagaaggaaguucagaagugugugaccauagguugaugucggcggcaaucaaagaccagaaagcuguacaugcugauaugggcuacuggauagagagcucaaaaaaccagaccuggcagauagagaaggcaucccucauugaagugaaaacaugucuguggcccaagacccacacauuguggaguaauggagugcuggaaagucagaugcucaucccgaaagcauaugcaggcccuuuuucacagcacaauuaccgucagggcuacgccacgcagaccaugggcccauggcacuugggaaaauuggagauagacuuuggagaaugccccggaacaacagucaccauucaagaggauugugaccauagaggcccgucuuugaggaccaccacugcaucugggaaacuggucacgcaguggugcugccgcuccugcacgaugccucccuuaagguuuuuaggagaggauggauguugguaugggauggaaauuaggcccuugagugaaaaagaagagaacaugguuaaaucacaggugucggccggacagggcacaucagaaacuuucuccauggggcuguugugccugacucuauuuguggaagaaugcuugaggagaagagucaccaggaaacacaugauauugguuguggugaccacccuuugugccaucaucuuaggaggucucacauggauggauuuacugcgagcccuuaucaugcuagggaacaccaugucuaguagaaugggaggacagacucaccuagccaucauggcaguguuuaaaaugucaccaggauacgugcuggguauauuuuugaggaaacucaccucaagagagacagcacuaauggugauaggaauggccaugacaacggugcuuucaauuccacaugaccuuauggaauucauugauggaauaucacuaggguugaucuuguuaaagaugguaacacauuuugacaacacucaaguaggaaccuuagcccuuuccuugaccuucauaaaaucaacaaugccauuggucauggcuuggaggaccauaauggcgguguuguuuguggucacacucauuccucuaugcaggacaagcugucuucagaagcagucccauuggguggaaauaacagcacucauccugggagcccaggcucugccaguauaccuaaugacucucaugaaaggagccucaaagagaucuuggccccuuaacgaagguauaauggcugugggcuuggucagucucuuaggaagcgcccuucuaaagaaugaugucccucuagcuggcccaaugguggcaggaggcuugcuucuggcagccuacgugaugagcgguagcucagcagaccugucacuagaaaaggcugcuacugugcagugggaugagauggcagacauaacaggcucaagcccaaucauagaagugaagcaggaugaagauggcucuuucuccauacgggacgucgaggaaaccaacaugauaacccuccuggugaaacuggcacugauaacagugucaggucucuaccccuuggcaauuccagucacaaugacccuaugguacauguggcaagugaaaacacaaagaucaggagcccugugggacguccccucaccugcugccacccagaaagccacacugacugaaggaguguacaggaucaugcaaagaggguuauuugggaaaacucagguuggaguagggauacacauggaagguguguuucacacaauguggcauguaacaagaggaucagugauuugccaugagagugggagacuggagccaucuugggcugacgucaagaaugacaugauaucauacggugggggauggaggcucggagacaaaugggauaaagaagaagacguucaaguucuggcuguagaaccagggaaaaauccaaaacauguccaaacgaaacccggccuuuucaaaacccuaacuggagaaauuggagcggugacauuggacuucaaacccggaacauccgguucucccaucaucaauaggaaaggaaaagucauuggacuuuacggaaaugggguaguuaccaaaucaggugauuacgucagugccauaacacaagcugaaagaauuggcgaaccagauuaugaaguggaugaggacaucuuucgaaagaaaagauugaccauaauggacuuacaccccggagccggaaagacaaaaagaauucuuccaucaaucguuagagaagcuuuaaaaaggaggcuacgaacccugauucuggcacccacgagagugguagcggccgaaauggaagaagcccuacgcggacugccaauccguuaccagaccccagcugugaaaacagaacacacaggaagggagaucguggaccucaugugccaugcaaccuucacaacaagacuuuuaucaucaaccaggguuccaaauuacaaccuuauagugauggaugaagcgcauuucacagacccuucuagugucgcagcuagaggauacaucucaaccaggguggaaaugggagaggccgcagcuaucuucaugacugcaaccccuccuggaacaacagaucccuucccccagagcaacagcccaauagaagauaucgagagggaaauuccagaaaggucauggaacacaggguuugacuggauaacagacuaccaagggaaaacugugugguuuguucccagcauaaaagcuggaaaugacauugcaaacugcuugagaaaaucgggaaagaaggugguccaauugaguaggaaaacuuuugacacagaguauccaaagacgaaacucacggacugggauuuugugguuaccacagacauaucugaaaugggggccaacuuuagagcugggagagugauagaccccaggagaugccucaagccaguuaucauaacugacgggccagagagaguuaucuuagcgggucccauuccagugacuccagcaagcgcugcucagagaagagggcgaauagguaggaacccagcacaagaagaugaccaauaugucuucucuggagacccacuaaggaaugaugaagaucaugcccacuggacugaagcaaagaugcuucuugacaauauccacaccccggaagggaucauuccaacacuguuugguccggaaagggaaaaaacccaagccauugauggagaguuccgccucagaggggaacaaaggaagacuuuuguagaauuaaugaggagaggagaccuuccgguguggcugaguuacaagguagcuucugcugguaucucuuacaaagaccgggaauggugcuucacgggggaaaggaauaaccaaauucuagaagaaaacauggagguagaaauuuggacuagagagggagagaagaaaaaacucaggccaaaaugguuagaugcacguguuuacgcugaccccguggcuuugaaggauuucaaggaguuugccaguggaaggaagagcauaacccucgacauccuaacagaaauugccaguuugccaacguaccuuuccucuagagcuaagcuugcccuugacaacauagucaugcuccacacaacagaaagaggagggaaggccuaccaacacgcccugaacgaacucccagagucacuagaaacacucaugcuuguagcuuuacuaggagcuaugacagcaggcaucuuuuuguucuucaugcaaggaaaaggaauggggaaauugucaauggguuugauagccaucgcgguagcuaguggcuugcucuggguagcagaaauccagccccaguggauagcagccucaauuauauuggaguuuuuucucauggcgcuguugauaccagaaccagaaaagcaaaggaccccacaagacaaucaauugaucuacgucauauugaccauucucaccauuauuggucucguagcagccaaugagauggggcuaauugaaaaaacaaaaacggacuuuggguuuuaccagguaaaaacagaaacuaccauccuugauguggauuuaagacccgccucagcauggacgcucuaugcaguagccaccacuaucuugacucccaugcugagacacaccauagaaaacacgucugcaaaccuaucuuuagcggccauugccaaccaagcagccgucuuaauggggcuuggaaaaggauggccgcuccacagaauggaccuuggugugccgcuauuggcaaugggaugcuauucccaggugaacccaacgacuuuaacagcauccuuagucaugcuuuuaguucauuaugcaauaauagguccaggauugcaggcuaaagccacaagagaagcucagaaaaggacagcugcugggaucaugaagaaccccacgguagacgggauaacaguuauagaucuagaaccaauauccuaugacccaaaauuugaaaagcaguuagggcagguuaugcuacuaguccugugcgcugggcaacuacucuugaugagaacaacaugggccuucugugaagucuugacuuuggccacaggaccaaucuugacccugugggagggcaacccgggaagauuuuggaacacgacuauagccguguccacagccaacauuuucaggggaagcuaccuggcgggagcuggauuggccuucucgcucauaaagaauacacaaacccccaggaggggaaccgggaccacaggagagacacugggagaaaaguggaagagacaacugaacucacuagauaggaaggaguuugaagaguacaaaagaaguggaauacuagaaguagacaggacugaagccaaauccgcccugaaagauggaucuaaaaucaaguaugcaguguccagagggaccagcaagauuagauggauuguugaaagagggaugguaaagccaaaagggaaaguuguggaccuugguugugggagaggaggguggucguacuacauggccacacucaagaacgugacugaggugaaaggguacacaaaaggagguccaggacaugaagaaccgauucccauggccaccuauggcuggaacuuggucaaacuccauucagggguugacguguucuacaaacccacugagcaaguggacacccugcucugugacauuggggagucauccucuaauccgacgauagaggaaggaagaacgcuaagaguuuugaagaugguggagccauggcucucuucaaagccugaauucugcaucaaaguucuuaaccccuacaugccaacagucauagaagagcuggagaaacugcagagaaaacaugguggaagucuugucagaugcccguuauccaggaauuccacucaugagauguauugggugucaggugugucaggaaacauugugagcucugugaacacaacaucaaagauguuguugaacagauuuaccacaagauauagaaaacccacuuaugagaaggacgcagaccuuggagcaggaacgagaagcgucuccacugaaacagaaaaaccagacauggcaaucaucgggagaagacuccagcgauugcaagaagagcacaaagaaacuuggcacuaugaucaagaaaauccauacagaaccugggcauaucauggaagcuaugaggcuccuucgacaggcucggcauccuccauggugaacgggguaguuaaauugcugacaaaacccugggacgugauuccaauggugacccaguuggcuaugacagacacaaccccuuuugggcaacagagaguguucaaagagaagguugacaccaggacaccacagccaaaacccggcacacgaaugaucaugaccacgacagccaacuggcuaugggcucuccucggaaagaagaaaaaucccagacugugcacaagggaagaguucaucucaaaaguuaggucgaaugcagccauaggcgcagucuuccaggaagaacagggauggacaucagccagugaagcugugaaugauagccgauuuugggaacugguugacaaagaaagggcucugcaccaggaagggaaaugugaaucaugugucuacaacaugaugggaaaacgugagaaaaaguuaggagaguuuggcagagccaagggaagccgggcaaucugguacauguggcugggagcgcgguuucuggaauuugaagcccuggguuuucugaaugaagaucauugguuuggcagggaaaacucauggaguggaguggaaggggaaggucugcauagguugggauacauccuggaggacauagauaagaaggauggagauuugauauaugcugaugacacagcaggcugggacacaagaaucacugaagaugaccuucugaaugaagagcugaucacagaacagauggccccucaccacaagauccuagccaaagccauuuucaaacuaacuuaucaaaacaaagugguaaaaguccucagacccacaccgaagggagcagugauggacaucauaucuaggaaagaucaaagagguaguggacagguuggaacauaugguuugaacacauucaccaacauggaaguacaacuuauccgccaaauggaagcugaaggagucaucacacgagaugacaugcauaacccaaaaggguugaaagaaagaguugagaaauggcugaaagaguguggugucgacagguuaaagaggauggcaaucagcggagacgauuguguggugaagccccuggaugagagguucagcacuucccuccucuucuuaaacgacaugggaaaggugaggaaagacaucccgcaaugggaaccauccaaaggguggaaaaauuggcaagagguucccuuuugcucccaccacuuucacaagaucuuuaugaaggauggccgcucacugguuguuccauguaggaaccaggaugaacugauagggagagccagaaucucgcaaggagcuggauggaguuuaagagagacagccugucuaggcaaagcuuacgcccagauguggucgcucauguauuuucauagaagggaccugcgcuuagccuccauggccauaugcucagcagucccaacggagugguuuccaacaagcagaacaacauggucaauccacgcucaucaucaauggaugaccacugaagauaugcucaaaguauggaacagaguguggauagaagacaacccuaacaugacugauaagacuccaguucauucgugggaagauauaccuuaccuagggaaaagagaggauuugugguguggauccuugauuggacucucuucuagggccaccugggcgaagaacauucacacagccauaacccaggucaggaaccugaucggaaaagaagaguauguagauuacaugccagucaugaaaagauacagcgcuccuuucgagagugaaggaguucuguaa

SEQ ID NO: 7790 - RNA, 9867 nt, Artificial Sequence
  derived and/or modified CDS sequence (wt) from DENV-4__FJ024476__SS-prME
ucaacgauaacauugcugugcuugauucccaccguaauggcguuucacuugucaacaagagauggugaaccccucaugauaguggcaaaacaugaaagggggagaccucucuuguuuaagacaacagaggggaucaacaaaugcacucucauugcuauggacuugggugaaaugugugaggacacugucacguauaaaugcccccuacuggucaauaccgaaccugaagacauugauugcuggugcaaccucacggcuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaucuggugcuagagcauggaggaugcgucacaaccauggcccagggaaaaccaaccuuggauuuugaacugacuaagacaacagccaaggaaguggcccuguugagaaccuauuguauugaagccucaauaucaaacauaacuacggcaacaagauguccaacgcaaggggagccuuaucugaaagaggaacaggaccaacaguacauuugccggagagaugugguagacagaggguggggcaauggcuguggcuuauuuggaaaaggaggaguugugacaugugcgaaguuuucauguucggggaagauaacaggcaauuugguccagauugagaaccuugaauacacagugguuguaacaguccauaauggagacacccaugcaguaggaaaugacacauccaaucauggagucacagccaugauaacuccuaggucaccaucaguggaagucaaauugccggacuauggagaacuaacacucgauugugaacccaggucuggaauugacuuuaaugagaugauucugaugaaaaugaaaaagaaaacauggcucgugcauaagcaaugguuuuuggaccugccucuuccauggacagcaggagcagacacaucagagguucacuggaauuacaaagagagaauggugacauuuaagguuccucaugccaagagacaggaugugacagugcugggaucucaggaaggagccaugcauucugcccucgccggagcuacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcguaucauuucauccacuccuuuggcugagaauaccaacaguguaaccaacauagaacuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggccgugcaccagguuuuuggaaguguauauacaaccauguuuggaggagucucauggaugauuagaauucuaauugggcucuuaguguuguggauuggcacgaacucaaggaacacuucaauggcuaugacgugcauagcuguuggaggaaucacucuguuucugggcuucacaguucaagcagacauggguuguguggugucauggagugggaaagaauugaaguguggaagcggaauuuuugugguugauaacgugcauacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguucucugggagggaggacaugaccucacuguaguggcuggggaugugaaggggguacuuaccaaaggcaagagagcacucacacccccagugagugaucugaaauauucauggaagacauggggaaaagcaagaaucuucaccccagaagcaagaaacagcacauuuuuaauagacggaccagacaccucugaaugccccaaugaacgaagagcauggaacucccuugagguggaagacuauggauuuggcauguucacgaccaacauauggaugaaauuccgggagggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccaugggcccauggcacuuaggcaaauuagagauaggcuuuggagaaugcccuggaacaacagucacaauccaggaggauugugaccauagaggcccaucuuugaggaccaccacugcaucuggaaaacuagucacgcaaugguguugccgcucuugcacgaugccucccuuaagguucuugggagaagaugggugcugguaugggauggagauuaggccccugagugaaagagaagagaacauggucaaaucacaggugacggccggacaaggcacaucagaaaccuuuucuaugggucuguugugccugaccuuguuuguggaagaaugcuugaggagaagagucacuaggaaacacaugauauuaguuguggugaucacucuuugugccauuauccugggaggccucacauggauggacuuacuacgagcccucaucauguugggggacacuaugucugguagaauaggaggacagauccaccuagccauuauggcaguguucaagaugucaccaggauacgugcuggguguguuuuuaaggaaacucacuucaagagagacagcacuaaugguaauaggaauggccaugacaacggugcuuucaauuccacaugaccucauggaacucauugauggaauaucacugggacuaauuuugcuaaaaauaguaacacaguuugacaacacucaagugggaaccuuagcucuuuccuugacuuucauaagaucaacaaugccauuggucauggcuuggaggaccaucauggcuguguuguuuguggucacacucauuccuuugugcaggacaagcugucuccaaaaacagucucauuggguagaaauaacagcacucauccuaggagcccaagcuuugccaguguaccuaaugacucuuaugaaaggagccucaagaagaucuuggccucuuaacgagggcauaauggcuguggguuugguuagucucuuaggaagcgcucucuuaaagaaugauguucccuuagcuggcccaaugguagcaggagguuuacuucuggcggcuuacgugaugaguggcagcucagcagaucugucacuagagaaggccgccaaugugcagugggaugaaauggcagacauaacaggcucaagcccaaucauagaaguaaagcaggaugaagauggcucuuucuccauacgggacgucgaggaaaccaauaugauaacccuauuggugaaacuggcacugauaacugugucaggucucuaccccuuggcaauuccggucacaaugaccuuaugguacauguggcaagugaaaacacaaagaucaggagcccugugggacguucccucacccgcugccacucaaaaagccgcacugucugaaggaguguacaggaucaugcaaagaggguuauucggaaaaacucagguuggaguagggauacacauggaagguguguuucacacaauguggcauguaacaagaggaucagugaucugccacgagacugggagacuggagccaucuugggcugacgucaggaaugacaugauaucauacggugggggauggaggcuuggagacaaaugggacaaagaagaagacguucagguccucgcuauagaaccaggaaaaaauccuaaacauguccaaacgaaaccuggucuuuucaagacccuaacuggagaaauuggagcaguaacauuagauuucaaacccggaacgucugguucucccaucaucaacaggaaaggaaaagucaucggacuuuauggaaauggaguaguuaccaaaucaggugauuacgucagugccauaacgcaagccgaaagaauuggagagccagauuaugaaguggaugaggacauuuuucgaaagaaaagauuaacuaucauggacuuacaccccggagcuggaaagacaaaaagaauucucccaucaauagugagagaagccuuaaaaaggaggcugcgaacuuugauuuuggcuccuacgagagugguggcagccgagauggaagaggcccuacgcggacugccaauccguuaucagaccccagcugugaaaucagaacacacaggaagagagauuguagaccucaugugucacgcaaccuucacaacaagacuuuugucaucaaccaggguuccaaauuacaaccuuauagugauggaugaagcacauuucaccgauccuucuagugucgcggcuagaggauacaucucgaccaggguggaaaugggagaggcagcagccaucuucaugaccgcaaccccucccggagcgacagaucccuuuccucagagcaacagcccaauagaagacaucgagagggaaauuccggaaaggucauggaauacaggguucgacuggauaacagacuaccaagggaaaacugugugguuuguucccagcauaaaagcuggaaaugacauagcaaauuguuugagaaagucgggaaagaaaguuguccaguugaguaggaaaaccuuugacacagaguauccaaaaacgaaacucacggauugggacuuuguggucacuacagacauaucugaaaugggggccaauuuuagagcugggagagugauagacccuagaagaugccucaagccaguuauccuaacagaugggccagagagaguuauuuuagcagguccuauuccagugacuccagcaagcgcugcgcagagaagagggcgaauaggaaggaacccagcacaagaagacgaccaauacguuuucuccggagacccacuaaaaaaugaugaagaucaugcccacuggacagaagcaaagauguugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauaucuuauaaagaucgggaauggugcuucacaggggaaagaaauaaccaaauuuuagaagaaaacauggagguugaaauuuggacuagagagggagaaaagaaaaagcuaaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagcuuuacuaggugcuaugacagcagguaucuuccuguuuuucaugcaagggaaaggaauagggaaauugucaauggguuugauaaccauugcgguggccaguggcuugcucuggguagcagaaauucaaccacaguggauagcggccucaaucauacuggaguuuuuucucaugguacuguugauaccagaaccagaaaaacaaaggaccccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagcuaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucccaagugaauccaacaaccuugacagcauccuuagucaugcuuuuaguccacuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaauuuugaccuugugggagggcaacccgggaagguuuuggaacacgaccauagccguguccaccgccaacauuuucaggggaagcuacuuggcgggagcuggacuggcuuuuucacucauaaagaaugcacaaaccccuagaaggggaacugggaccacaggagagacacugggagaaaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagagggucuagcaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagagucuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaaccuggcauuaugaucaggaaaacccauacagaaccugggcguaucauggaagcuacgaagcuccuucgacaggcucugcauccuccauggugaacgggguagugaaacugcuaacaaaacccugggaugugauuccaauggugacucaguuagccaugacagacacaaccccuuuugggcaacaaagaguguucaaagagaagguggauaccagaacaccacaaccaaaacccggaacacgaaugguuaugaccacgacagccaauuggcugugggcccuccuuggaaagaagaaaaaucccagacugugcacaagggaagaguucaucucaaaagucagaucaaacgcagccauaggcgcagucuuccaggaagaacaaggauggacaucagccagugaagcugugaaugacagccgguuuugggaacugguugacaaagaaagggcccuacaccaggaagggaaaugugaaucgugugucuauaacaugaugggaaaacgugagaaaaaguuaggagaguuugguagagccaagggaagccgagcaaucugguacauguggcugggagcgcgguuuuuggaauuugaagcccuggguuuuuugaaugaagaccacugguuuggcagagaaaauucauggaguggaguggaaggggaaggccugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguagugaaaguccucagacccacaccgagaggagcggugauggauaucauuuccaggaaagaccaaagagguaguggacaaguuggaacauauggucugaacacauucaccaacauggaaguucaacucauccgccaaauggaagcugaaggagucaucacacaagaugacaugcagaacccaaaaggguugagagaaagaguugagaaaugguugaaagaguguggcgucgacagguuaaaaaggauggcaaucaguggagacgauugcguggugaagccccuagaugagagguuuggcacuucccuccucuucuugaaugacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagccuaagagaaacagccugucugggcaaagcuuacgcccagauguggucgcuuauguacuuucacagaagggaucugcgcuuggccuccauggccauaugcucagcaguuccaacagaaugguuuccaacaagcagaacaacauggucaauccacgcucaucaccaguggaugaccacugaagauaugcucaaaguguggaacagaguguggauagaagacaauccuaauaugacugacaagacuccaguccauucgugggaagauauaccuuaccuaggaaaaagagaggauuugugguguggaucccugauuggacuuucuuccagagccaccugggcgaagaacauucacacggccauaacccaggucaggaaccugaucgggaaagaggaauacguggauuacaugccaguaaugaaaagauacagugcuccuucagagagugaaggaguucuguaa

SEQ ID NO: 7791 - RNA, 9867 nt, Artificial Sequence
  derived and/or modified CDS sequence (wt) from DENV-4__GQ868579__SS-prME
ucaacgauaacauuguugugcuugauccccaccauaauggcguuucacuugucgacaagagauggcgaaccccucaugauaguggcaaaacaugaaagggggagaccucucuuguucaagacaacagaggggaucaacaaaugcacucucauugccauggauuugggugaaaugugugaggacacugucacguacaaaugcccccuacugaucaauaccgaaccugaagacauugauugcuggugcaaccucacgucuaccugggucauguaugggacaugcacccagagcggugaacggagacgagagaagcgcucaguagcuuuaacaccacauucaggaaugggauuggaaacaagagcugagacauggaugucaucggaaggggcuuggaagcacgcucagagaguagagagcuggauacucagaaacccaggauuugcgcucuuggcaggauuuauggcuuauaugauugggcaaacaggaauccagcgaacugucuucuuuauccuaaugaugcuggucgccccauccuacggaaugcgaugcguaggaguaggaaacagagacuuuguggaaggagucucagguggagcaugggucgaccuggugcuagaacauggagggugcgucacaaccauggcccagggaaaaccaaccuuggauuuugaacugacuaagacaacagccaaggaaguagcucuguuaagaaccuauugcauugaagccuuaauaucaaacauaacuacggcaacaagauguccaacgcaaggagagccuuaccugaaagaggaacaggaccaacaguacaucugccggagagaugugguagacagaggauggggcaauggcuguggcuuguucggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacagugugaccaacauagaauuagaacccccuuuuggggacagcuacauagugauagguguuggaaauagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaucagguuuuuggaaguguguauacaaccauguuuggaggagucucauggaugauuagaauccuaauuggguucuuaguuuuguggauuggcacgaacucaaggaacacuucaauggccaugacgugcauagcuguuggaggaaucacucuguuuuugggcuucacaguucgagcggacauggguuguguggugucauggagugggagagaauugaaguguggaagcggaauuuuugugguugacaacgugcacacuuggacagaacaguacaaauuccagccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaccugaaauauucauggaagacauggggaaaagcaaaaaucuucaccccugaagcaagaaacagcacauuuuugauagacggaccagacaccucugaaugccccaaugaacgaagagcauggaauucucuugagguggaagacuauggauuuggcauguucacuaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaagaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggccccugagugaaaaagaagagaacaugguuaaaucacaggugacggccggacagagcacaucggaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaucuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggacuauuauggcuguguuguuuguggucacacucauuccuuugugcaggacaagcugucuucaaaaacagucucauuggguagaaauaacagcacucaucuuaggagcccaagcucugccaguguaccugaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagccgaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaucccuuggcaauuccagucacaaugaccuugugguacauguggcaagugaaaacacaaagaucaggagcucugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagacuggagccaucuugggcugacgucaggaaugacaugauaucauacggugggggauggaggcuuggagacaaaugggacagagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuauuaacaagaaaggaaaagucaucggacucuauggaaauggaguggucaccaaaucaggugauuacgucagugccauaacgcaagccgaaagaauuggagagccagauuaugaaguggaugaggacauuuuucgaaagaaaagacuaacuauaauggacuuacaccccggugcuggaaagacaaaaagaauucuuccaucaauagugagagaagccuuaaaaaggaggcugcgaacuuugauuuuggcccccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagcuaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcaggucccauuccagugacuccagcaagcgcugcucagagaagagggcgaauaggaaggaacccagcacaagaagaugaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccaucgauggagaguuucgccucagaggggaacaaaggaagacuuuuguggaauuaaugaggagaggagaccuuccgguguggcugagcuauaagguagcuucugcuggcauuucuuacaaagaucgggaauggugcuucacuggggaaagaaacaaccaaauuuuagaagaaaacauggagguugaaauuuggacuagagagggagaaaagaaaaaacugaggccaagaugguuagaugcacguguauacgcugacccuauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacuuaugcuuguagccuuacuaggugcuaugacagcagguaccuuccuguuuuucaugcaagggaaaggaauagggaaauugucaauggguuugauaaccauugcgauggcuaguggcuugcucuggauagcagaaauucaaccccaguggauagcagccucaaucauacuggaguuuuuucucaugguacuguugauaccagaaccagaaaaacaaaggaccccacaagacaaucaauugaucuacgucauauugaccauucucgccauuauuggucuaauagcagccaacgaaauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaccuagaaccaauauccuaugacccaaaauuugaaaagcaauuagggcaggucaugcuacuagucuuaugugcuggacaacuacucuuaaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaagccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguuucuagaggguccaguaagaucagauggaucguugagagagggaugguaaagccaaaagggaaaguuguagaucuuggcugugggagaggaggauggucuuauuauauggcgacacucaagaacgugacugaagugaaaggguauacaaaaggagguccagggcaugaagaaccgauucccauggcuacuuauggcuggaauuuggucaaacuccauucagggguugacguguucuacaaacccacagagcagguggacacccugcucugugacauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggacaccagaacaccgcaaccaaaaccaggcacacgaaugguuaugaccacgacagccaauuggcuaugggcccuccuuggaaagaagaaaagucccagacugugcacaagggaagaguucaucucgaaaguuagaucaaacgcagccauaggcgcagucuuucaggaggaacagggauggacaucagccagugaagcugugaaugacagccgguuuugggaacugguugacaaagaaagggcccuucaccaagaagggaaaugugaaucgugugucuauaacaugaugggaaaacgugaaaaaaaauuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacuuauccgccaaauggaagcugaaggagucaucacacaagaugacaugcagaacccaaaaggguugaaagaaagaguugagaacuggcugagagaguguggugucgacagguuaaagaggauggcaaucaguggagacgauuguguagugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucauuaguuguuccauguagaaaccaggaugaacugauagggagggccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaacaugauugacaagacuccaguccauucgugggaagauauaccuuaccuaggaaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7792 - RNA, 9867 nt, Artificial Sequence
  derived and/or modified CDS sequence (wt) from DENV-4__GQ868580__SS-prME
ucaacgauaacauuguugugcuugauucccaccauaauggcguuucacuugucgacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacugaucaauaccgaaccugaagacauugauugcuggugcaaccucacgucuaccugggucauguaugggacaugcacccagagcggugaacggagacgagagaagcgcucaguagcuuuaacaccacauucaggaaugggauuggaaacaagagcugagacauggaugucaucggaaggggcuuggaagcacgcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguagcucuguuaagaaccuauugcauugaagccuuaauaucaaacauaacuacggcaacaagauguccaacgcaaggagagccuuaccugaaagaggaacaggaccaacaguacaucugccggagagaugugguagacagaggauggggcaauggcuguggcuuguucggaaaaggaggaguugugacaugugcgaaguuuucauguucggggaagauaacaggcaaucugguccaaauugagaaccuagaauacacagugguuguaacaguccacaauggagacacccaugcaguaggaaaugacacauccaaccauggaguuacagcuacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcauuaucucauccaccccuuuggcugagaauaccaacaguguaaccaacauagaauuagaacccccuuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuuggcuccguugguggacuguucacaucauugggaaaggcugugcaccagguuuuuggaaguguguauacaaccauguuuggaggagucucauggaugauuagaauccuaauuggguucuuaguuuuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaacgcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaccugaaauauucauggaagacauggggaaaagcaaaaaucuucaccccugaagcaagaaacagcacauuuuugauagacggaccagacaccucugaaugccccaaugaacgaagagcauggaauucucuugagguggaagacuauggauuuggcauguucacuaccaacauauggaugaaauuccgagaaggaaguucagaagugugugaccacagguuaaugucggcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaagaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggccccugaaugaaaaagaagagaacaugguuaaaucacaggugacggccggacagagcacaucggaaacuuuuucuaugggucuguugugccugaccuuguuuguggaagaaugcuugaggagaagagucacuaggaaacacaugauauuagcugugguaaucacucuuugugcuaucauccugggaggucucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacauuuucaauuccacaugaucuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggacuaucauggcuguguuguuuguggucacacucauuccuuugugcaggacaagcugucuucaaaaacagucucauuggguagaaauaacagcacucaucuuaggagcccaagcucugccaguguaccugaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagccgaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuugugguacauguggcaagugaaaacacaaagaucaggagcucugugggacguccccucacccgcugccacucaaaaagccgcacugucugaaggaguguacaggaucaugcaaagaggguuacucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacagagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagggaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagcuaucuucaugaccgcaaccccucccggagcgacagaucccuuuccccagagcaacagcccaauagaagacaucgagagagagauuccagaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagaugaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacuggggaaagaaacaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuucacacaacagaaagaggagggagggccuaucaacacgcccugaacgaacuuccggagucacuggaaacacuuaugcuuguagccuuacuaggugcuaugacagcagguaucuuccuguuuuucaugcaagggaaaggaauagggaaauugucaauggguuugauaaccauugcgauggcuaguggcuugcucuggauagcagaaauucaaccccaguggauagcggccucaaucauacuggaguuuuuucucaugguacuguuaauaccagaaccagaaaaacaaaggaccccacaagacaaucaauugaucuacgucauauugaccauucucaccauuauuggucuaauagcagccaacgaaauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaccuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguacaaaagaaguggaauacuagaaguggacaggacugaagccaagucugcccuuaaagaugggucuaaaaucaagcaugcaguuucuagaggguccaguaagaucagauggaucguugagagagggaugguaaagccaaaagggaaaguuguagaucuuggcugugggagaggaggauggucuuauuauauggcgacacucaagaacgugacugaagugaaaggguauacaaaaggagguccagggcaugaagaaccgauucccauggcuacuuauggcuggaauuuggucaaacuccauucagggguugacguguucuacaaacccacagagcagguggacacccugcucugugacauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaacuccuuuugggcaacaaagaguguucaaagagaagguggauaccagaacaccgcaaccaaaaccaggcacacgaaugguuaugaccacgacagcuaauuggcuaugggcccuccuuggaaagaagaaaagucccagacugugcacaagggaagaguucaucucaaaaguuaggucaaacgcagccauaggcgcagucuuucaggaggaacagggauggacaucagccagugaagcugugagugacagccgguuuugggaacugguugacaaagaaagggcccuucaccaagaagggaaaugugaaucgugugucuauaacaugaugggaaaacgugagaaaaaguuaggagaguuugguagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauauaguuugaacacauucaccaacauggaaguucaacucauccgccaaauggaagcugaaggagucaucacacaagaugacaugcagaacccaaaaggguugaaagaaagaguugagaacuggcugagagaguguggugucgacagguuaaagaggauggcaaucaguggagacgauuguguagugaagcccuuggaugagagguuuggcacuucccuccucuucuugaacgacaugggaaaggugaggaaagacauuccgcagugggaaccaucuaagggauggaaaaacuggcaagagguuccuuuuugcucccaccacuuccacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaacaugauugacaagacuccaguccauucgugggaagauauaccuuaccuaggaaaaagagaggauuugugguguggaucccugauuggacuuucuucuagagccaccugggcgaagaacauucacacggccauaacucaggucaggaaccugaucggaaaagaggaauacguggauuacaugccagucaugaaaagauacagugcuccuucagagagugaaggaguucuguaa

SEQ ID NO: 7793 - RNA, 9867 nt, Artificial Sequence
  derived and/or modified CDS sequence (wt) from DENV-4__GQ868583__SS-prME
ucaacgauaacauuguugugcuugauucccaccguaauggcguuucacuugucaacaagagauggcgaaccccucaugauaguggcaaaacaugaaagggggagaccucucuuguuuaaaacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagaaaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagcccuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucaugggguuacagccacgauaacucccaggucaccaucgguagaagucaaacugccggacuauggagaauuaacacucgauugugaacccaggucuggaauugacuucaaugagaugauccuaaugaaaaugaaaaagaaaacauggcucgugcauaagcaaugguuuuuggaucugccucuuccauggacaacaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguucguauggagaaauugagaaucaagggaaugucauacacgaugugcucaggaaaguuuucaauugacaaagagauggcagaaacacagcaugggacaacaguggugaaagucaaguaugaaggugcuggagcuccguguaaaguccccauagagauaagagaugugaacaaggaaaaagugguugggcgcgucaucucagccaccccuuuggcugagaauaccaacaguguaaccaacauagaauuagaaccccccuuuggggacagcuacauaaugauagguguuggaaacagcgcacuaacacuccauugguucaggaaagggaguuccauuggcaagauguuugaguccacauauagaggugcaaaacgcauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaagggcaagagagcacucgcacccccagcgagugaucugaaauauucauggaagacauggggaaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagccgcaauuaaagaccagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguuccugggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuuguuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaaugagggcauaauggcuguggguuugguuagucuccuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccagucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagacaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaagauauuuuucgaaagaaaagauuaacuauaauggacuuacacccuggagcuggaaagacaaaaagaauucuuccaucaauagugagagaagccuuaaaaaggaggcugcgaacuuugauuuuggcucccacgagagugguggcggccgagauggaagaggcccuucguggacugccaauccguuaccagaccccagcugugaaaucagaacacacaggaagagagauuguagaccucaugugccaugcaaccuucacaacaagacuuuugucaucaaccaggguuccaaauuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguuaaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugcaggauuucaaggaguuugccaguggaaggaagaguauaacucucgacauccuaacagagaucgccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaauuauacuggaguuuuuucucauggugcuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaaguuuugacuuuggccacaggaccaaucuugaccuugugggagggcaacccgggaagguuuuggaacacgaccauagccguauccaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccacucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuauaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaggaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaaugcagccauaggcgcagucuuucaggaggaacagggauggacaucagccagugaagcugugagugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaagauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaggagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcagucccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggaucuaugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7794 - RNA, 9867 nt, Artificial Sequence
  derived and/or modified CDS sequence (wt) from DENV-4__GQ868584__SS-prME
ucaacgauaacauuguugugcuugauucccaccguaauggcguuucacuugucaacaagagauggcgaaccccucaugauaguggcaaaacaugaaagggggagaccucucuuguuuaaaacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagaaaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagcccuaauaucaaacauaacuacggcaacaagauguccaacgcaaggagagccuuaucugaaagaggaacaggaccgacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucaugggguuacagccacgauaacucccaggucaccaucgguagaagucaaacugccggacuauggagaauuaacacucgauugugaacccaggucuggaauugacuucaaugagaugauccuaaugaaaaugaaaaagaaaacauggcucgugcauaagcaaugguuuuuggaucugccucuuccauggacaacaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguucguauggagaaauugagaaucaagggaaugucauacacgaugugcucaggaaaguuuucaauugacaaagagauggcagaaacacagcaugggacaacaguggugaaagucaaguaugaaggugcuggagcuccguguaaaguccccauagagauaagagaugugaacaaggaaaaagugguugggcgcgucaucucagccaccccuuuggcugagaauaccaacaguguaaccaacauagaauuagaaccccccuuuggggacagcuacauaaugauagguguuggaaacagcgcacuaacacuccauugguucaggaaagggaguuccauuggcaagauguuugaguccacauauagaggugcaaaacgcauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaagggcaagagagcacucgcacccccagcgagugaucugaaauauucauggaagacauggggaaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagccgcaauuaaagaccagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguuccugggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuuguuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaaugagggcauaauggcuguggguuugguuagucuccuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccagucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagacaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaagauauuuuucgaaagaaaagauuaacuauaauggacuuacacccuggagcuggaaagacaaaaagaauucuuccaucaauagugagagaagccuuaaaaaggaggcugcgaacuuugauuuuggcucccacgagagugguggcggccgagauggaagaggcccuucguggacugccaauccguuaccagaccccagcugugaaaucagaacacacaggaagagagauuguagaccucaugugccaugcaaccuucacaacaagacuuuugucaucaaccaggguuccaaauuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguuaaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaauuauacuggaguuuuuucucauggugcuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaaguuuugacuuuggccacaggaccaaucuugaccuugugggagggcaacccgggaagguuuuggaacacgaccauagccguauccaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccacucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuauaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaggaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaaugcagccauaggcgcagucuuucaggaggaacagggauggacaucagccagugaagcugugagugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaagauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaggagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcagucccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggaucuaugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7795 - RNA, 9867 nt, Artificial Sequence
  derived and/or modified CDS sequence (wt) from DENV-4__GQ868585__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcauggguugaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugaugaaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuugggcaaacuagagauagacuuuggagaaugccccggaacaacaguuacaauucaggagaauugugaucauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacugauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacuuauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucccccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuaucccagugacuccagcaagcgcugcccagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguggcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuauagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaacgaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7796 - RNA, 9867 nt, Artificial Sequence
  derived and/or modified CDS sequence (wt) from DENV-4__JQ922560__SS-prME
ucaacaauaacauuguugugcuugauucccaccguaauggcguuucacuugucaacgagagauggcgaaccccuuaugauaguggcgaaacacgaaagggggagacgucucuuguucaagacaacagaaggaaucaacaagugcacucucauugccauggaccugggugaaaugugcgaggacaccguuacguauaaaugccccuugcuggucaacaccgaaccugaagacauugauugcugguguaaucucacgucugccugggucauguaugggacaugcacccaaaguggggaacggagacgagagaagcgcucaguagcucuaacaccacauucaggaaugggauuggaaacaagggcugaaacauggaugucaucggaaggagcuuggaaacacgcccagaggguagagaguuggauacucagaaacccaggauucgcgcucuuggcaggauuuauggccuauaugauugggcaaacaggaauccagcggacagucuucuuuauuuuaaugaugcuggucgcuccauccuacggaaugcgauguguaggaguggggaacagagacuucguggaaggagucucagguggagcaugggucgaucuggugcuagaacauggaggauguguuacaaccauggcccagggaaaaccaaccuuggauuuugaacugaucaagacaacggcuaaggaaguggcucuguuaagaaccuauugcaucgaagccuccauaucaaacauaaccacggcaacaagauguccaacgcaaggagagccuuaccuuaaagaggaacaagaucaacaguacauuugccggagagacgugguagacagaggguggggcaauggcuguggccuguuugggaaaggaggaguugugacaugugcgaaguuuucaugcacggggaagauaacaggcaacuuaauccaaauugagaaccuagaauacacagugguuguaacaguccacaauggagacacccaugcaguaggaaaugacacauccaaccacggagugacagcuacgauaacccccaggucaccaucgguagaaguugaauugccggacuauggagaguugacacucgauugugagcccagguccggaauugacuuuaaugagaugauucugaugaaaaugaauaagaaaacguggcucgugcacaagcaaugguuuuuggaucuaccucuaccaugggcagcaggagcagacacgucagaaguucauuggaaucacaaagaaagaauggugacguuuaaggucccucaugccaagagacaggaugugacagugcuaggaucucaggaaggagccaugcauucagcccucaccggagccacggaaguauauuccggugauggaaaccucauguuugcaggacauuugaaaugcaaaguucgcauggagaaauugaggaucaagggaaugucauacacgaugugcucaggaaaguuuucaauugauaaagaaauggcagaaacacagcaugggacaacagugguaaaagucaaguaugagggugcuggagcuccaugcaaaguucccauagagauaagagaugugaacaaggaaaaagugguugggcgugucaucucaucuaccccuuuugcugagaauaccaacagugugaccaauauagaacuggaaccccccuuuggggauagcuauauaguaauagguguaggagacagcgcacugacacuucauugguucacgaaaggaaguuccaucggcaagauguuugaguccacauacagaggcgcaaagcguauggccauucuaggugaaacagcuugggauuuuggcucuguugguggacugcucacaucauugggaaaggcuguacaccaaguuuuugguaguguguauacaacuauguucggaggagucucauggaugguuagaauccuaauuggguucuuaguauuguggauuggcacgaauucaagaaacaccucaauggcaaugucaugcauagcuguuggagggauuacuuuguuucuggguuucacaguccaugcagacauggguugugcggugucauggagugggaaagaauugaaguguggaagcggaaucuuuauaauugacaacgugcacacuuggacagaacaguacaaguuccaaccagagucaccagcgagacuagcguccgcaauacugaaugcccacaaagauggggucuguggaauuagaucaaccacgagguuggaaaaugucauguggaagcaaauaaccaaugaguuaaacuaugugcucugggaaggaggacaugaccucacuguaguggccggggacgugaaagggguguuauccaaaggcaagagagcacuagcaccuccagugaaugaucugaaauauucauggaagacauggggaaaagcaaagaucuucacuccagagacaagaaacagcacauucuuaauagacggaccagacaccuccgaaugucccaaugaacgaagagcauggaauuuucuugagguagaagacuacggauuuggcauguucacgaccaacauauggaugaaauuucgagaaggaaguucagaaaugugugaccacagguugaugucggcggcaaucaaagaccagaaagcuguacaugcugauaugggcuacuggauagagagcucaaaaaaccagaccuggcagauagagaaggcaucccucauugaagugaaaacaugucuauggcccaagacccacacauuguggagcaauggagugcuggaaagccagaugcucaucccgaaagcauaugcaggcccuuuuucacagcacaauuaccgccagggcuacgccacgcagacugugggcccauggcacuugggaaaacuggagauagacuuuggagaaugccccggaacaacagucaccauucaagaggauugugaccauagaggcccgucuuugaggaccaccacugcaucuggaaaacuggucacgcaguggugcugccgcuccugcacgaugccucccuuaagguuuuuaggagaggauggauguugguaugggauggaaauuaggcccuugagugaaaaagaagagaauaugguuaaaucacaggugucggccggacaggguacaucagaaacuuuuuccauggggcuguugugccugacucuauuuguggaagaaugcuugaggagaagagucaccaggaaacacaugauauugguuguggugaccacccuuugugccaucaucuuaggaggucucacauggauggacuuacugcgagcccuuaucaugcuagggaacaccaugucuaguagaaugggaggacagauucaccuagccaucauggcaguguuuaagaugucaccaggauacgugcuggguauauuuuugaggaaacucacuucaagagagacagcacuaauggugauaggaauggccaugacaacggugcuuucaauuccacaugaccuuauggaauuuguugauggaauaucacuaggguugaucuuguuaaagaugguaacacauuuugacaacacucaaguaggaaccuuagcccuuuccuugacuuucauaaaaucaacaaugccauuggucauggcuuggaggaccauaauggcgguguuguuuguggucacacucauuccucuaugcaggacaagcugucuucagaagcagucccauuggguggaaauaacagcacucauccugggagcccaggcucugccaguguaccugaugacucucaugaaaggagccucaaagagaucuuggccccuuaacgaagguauaauggcugugggcuuggucagucucuugggaagcgcccuucuaaagaaugaugucccucuagcuggcccaaugguggcaggaggcuuacuucuggcagccuacgugaugagcgguagcucagcggaccugucacuagagaaggcugccacugugcagugggaugagauggcagacauaacaggcucaagcccaaucauagaagugaagcaggaugaagacggcucuuucuccauacgggacgucgaggaaaccaacaugauaacccuccuggugaaacuggcacugauaacagugucaggucucuaccccuuggcaauuccagucacaaugacccuaugguacauguggcaagugaaaacacaaagaucaggagcccugugggacguucccucaccugcugccgcucagaaagccacacugacugaaggaguguacaggaucaugcaaagaggguuauuugggaaaacucagguuggaguggggauacacauggaagguguguuucacacaauguggcauguaacaagaggaucagugaucugccaugagagugggagacuggagccaucuugggcugacgucaggaaugacaugauaucauacggugggggauggaggcucggagacaaaugggauaaagaagaagacguucaaguucuagcuguagaaccagggaaaaauccgaaacauguccaaacgaaacccggccuuuucaaaacccuaacuggagaaauuggagcgguaacauuggacuucaaacccggaacauccgguucucccaucauuaauaggaaaggaaaagucauuggacuuuauggaaaugggguagucaccaaaucaggugauuacgucagugccauaacacaagcugaaagaauuggcgaaccagauuaugaaguggaugaggacaucuuccgaaagaaaagauugaccauaauggacuuacaccccggagccggaaagacaaaaagaauucuuccaucaaucguuagagaagcuuuaaaaaggaggcuacgaacccugauccuggcacccacgagagugguggcggccgaaauggaagaagcccuacgcggacugccaauccguuaccagaccccagcugugaaaucagaacacacaggaagggagaucguagaccucaugugccaugcaaccuucacaacaagacuuuuaucaucaaccagaguuccaaauuacaaccuuauagugauggaugaagcgcauuucacagacccuucuagugucgcagcuagaggauacaucucaaccaggguggaaaugggagaggccgcagcuaucuucaugacugcaaccccuccuggaacaacagaucccuucccccagagcaauagcccaauagaagauaucgagagagaaauuccagaaaggucauggaacacaggguuugacuggauaacagacuaucaagggaaaacugugugguuuguucccagcauaaaagcuggaaaugacauugcaaacugcuugagaaaaucgggaaagaaggugguccaauugaguaggaaaaccuuugacacagaauauccaaaaacgaaacucacggacugggauuuugugguuaccacagacauaucugaaaugggggccaacuuuagagcugggagagugauagaccccaggagaugccucaagccaguuaucauaacugacgggccagagagaguuaucuuagcggguccuauuccagugacuccagcaagcgcugcucagagaagagggcgaauagguaggaacccagcacaagaagaugaccaauaugucuucucuggagacccacuaaggaaugaugaagaucaugcccacuggacugaagcaaagaugcuucuugacaauaucuacaccccagaagggaucauuccaacacuguuugguccggaaagggaaaaaacccaagccauugauggagaguuccgccucagaggggaacaaaggaagacuuuuguagaauuaaugaggagaggagaucuuccgguguggcugaguuacaagguagcuucugcugguaucucuuacaaagaccgggaauggugcuucacgggggaaaggaauaaccaaauucuagaagaaaacauggagguagaaauuuggacuagagagggagagaagaaaaaacucaggccaaaaugguuagaugcacguguuuacgcugaccccguggcuuugaaggauuucaaggaguuugccaguggaaggaagagcauaacccuugacauccuaacagaaauugccaguuugccaacguaccuuuccucuagagcuaagcuugcccuugacaacauagucaugcuccacacaacagaaagaggagggaaggccuaccaacacgcccugaacgaacucccagagucacuagaaacacucaugcuuauagcuuuacuaggagcuaugacagcaggcaucuucuuguucuucaugcaaggaaaaggaauggggaaauugucaauggguuugauagccaucgcgguagcuaguggcuugcucuggguagcagaaauccagccccaguggauagcagccucaaucauauuggaguuuuuucucauggcgcuguugauaccagaaccagaaaaacaaaggaccccacaagacaaucaauugaucuacgucauauugaccauucucaccauuauuggucucguggcagccaaugagauggggcuaauugaaaaaacaaaaacggacuuuggguuuuaccaggaaaaaacagaaaccaccauccuugauguggauuugagacccgccucagcauggacgcucuaugcaguagccacuacuaucuugacucccaugcugagacacaccauagaaaacacgucugcaaaccuaucuuuagcggccauugccaaccaagcagccguuuuaauggggcuuggaaaaggauggccgcuccacagaauggaccuuggugugccgcuauuagcaaugggaugcuauucccaagugaacccaacgacuuuaacagcauccuuagucaugcuuuuaguucauuaugcaauaauagguccaggauugcaggcuaaagccacaagagaagcucagaaaaggacagcugcugggaucaugaagaaccccacgguggacgggauaacaguuauagaucuagaaccaauauccuaugacccaaaauuugaaaagcaguuagggcagguuauguuacuaguccugugcgcugggcaacuacucuugaugagaacaacaugggccuucugugaagucuugacuuuggccacaggaccaaucuugacccugugggagggcaacccgggaagguuuuggaacacgacuauagccguguccacagcuaacauuuucaggggaagcuaccuggcgggagcuggauuggccuucucgcucauaaagaauacacaaacccccaggaggggaaccgggaccacaggagagacacugggagaaaaguggaagagacaacugaacucacuagauaggaaggaguuugaagaguacaaaagaaguggaauacuagaaguagacaggacugaagccaaaucugcccugaaagauggaucuaaaaucaaguaugcaguguccagagggaccagcaagauuagauggauuguugaaagagggaugguaaagccaaaagggaaaguuguggaccucggcugugggagaggaggauggucguacuacauggccacacucaagaacgugacugaggugaaaggguacacaaaaggggguccaggacaugaagaaccgauuccuauggccaccuauggcuggaacuuggucaaacuccauucagggguugacguguucuacaaaccuacugagcaaguggacacccugcucugugauauuggggagucauccucuaauccgacgauagaggaaggaagaacgcuaagaguuuugaagaugguggagccauggcucucuucaaagccugaauucugcaucaaaguucuuaaccccuacaugccaacagucauagaagagcuggagaaacugcagagaaaacaugguggaagucuugucagaugcccguuauccaggaauuccacucaugagauguauugggugucaggugugucacgaaacauugugagcucugugaacacaacaucaaagauguuguugaacagauuuaccacaagauauagaaaacccacuuaugagaaggacgcagaccuuggagcaggaacgagaagugucuccacugaaacagaaaaaccagacauggcaaucauugggagaagacuccagcgauugcaagaagagcacaaagaaacuuggcacuaugaucaagaaaauccauacagaaccugggcauaucauggaagcuaugaggcuccuucgacaggcucggcauccuccauggugaacgggguaguuaaacugcugacaaaaccuugggacgugguuccaauggugacccaguuggcuaugacagacacaaccccuuuugggcaacagagaguguucaaagagaagguugacaccaggacgccacagccaaaacccggcacacgaaugaucaugaccacgacagccaacuggcugugggcucuccucgggaagaagaaaaaucccagacugugcacaagggaggaguucaucucaaaagucaggucgaaugcagccauaggcgcagucucccaggaagaacagggauggacaucagccagugaagcugugaaugacagccgauuuugggaacugguugacaaagaaagggcucugcaccaggaagggaaaugugaaucaugugucuacaacaugaugggaaaacgugagaaaaaguuaggagaguuuggcagagccaagggaagccgagcaaucugguacauguggcugggagcgcgguuucuggaauuugaagcccuggguuuucugaaugaagaucacugguuugguagggaaaacucauggaguggaguggaaggggaaggucugcauagguugggauacauccuggaggacauagauaagaaagauggagauuugauauaugcugaugacacagcaggcugggacacaagaaucacugaagaugaccuucugaaugaagagcugaucacagaacagauggccccucaccacaagauccuagccaaagccauuuucaaacuaacuuaucaaaacaaagugguaaaaguccucagacccacaccgaagggagcagugauggacaucauaucuaggaaagaucaaagagguaguggacagguuggaacauaugguuugaacacauucaccaacauggaaguacaacuuauccgccaaauggaagcugaaggagucaucacacgagaugacaugcauaacccaaaaggguugaaagaaagaguugagaaauggcugaaagaguguggugucgacagguuaaagaggauggcaaucagcggagacgauuguguggugaagccucuggaugagagguucagcacuucccuccucuucuuaaacgacaugggaaaggugaggaaagacaucccgcaaugggaaccauccaaaggguggaaaaacuggcaagagguuccuuuuugcucccaccacuuucacaagaucuuuaugaaggauggccgcucacugguuguuccauguaggaaccaggaugaacugauagggagagccagaaucucacaaggagcuggauggaguuuaagagaaacagccugucugggcaaagcuuacgcccagauguggucgcucauguauuuucauagaagggaccugcgcuuagccuccauggccauaugcucagcagucccaacggagugguuuccaacaagcagaacaacauggucaauccacgcucaucaucaauggaugaccacugaagauaugcucaaaguauggaacagaguguggauagaagacaacccuaacaugacugauaagacuccaguucauucgugggaagacauaccuuaccuagggaaaagagaggaucugugguguggauccuugauuggacucucuucuagggccaccugggcgaagaacauucacacagccauaacucaggucaggaaccugaucggaauagaggaguauguagauuacaugccagucaugaaaagauacagcgcuccuuucgagagugaaggaguucuguaa

SEQ ID NO: 7797 - RNA, 9867 nt, Artificial Sequence
  derived and/or modified CDS sequence (wt) from DENV-4__JQ922558__SS-prME
ucaacauuaacauugcugugcuugauucccaccguaauggcguuucaccugucaacaagagauggcgaaccccuuaugauaguagcaaaacaugaaagggggagaccucuuuuguuuaagacaacagaaggaaucaacaaaugcacucuuauugccauggacuugggugaaaugugugaggacacugucacguacaagugcccucuacuggucaauaccgaaccugaagacauugacugcuggugcaaucucacguccaccugggucauguaugggacauguacccagagcggagaacggagacgagagaagcgcucaguagcuuuaacaccacauucaggaaugggauuggaaacaagggcugagacauggaugucaucggaaggagcuuggaagcacgcccaaagaguagagagcuggauacucagaaacccaggauucgcgcucuuggcaggauucauggcuuacaugauugggcaaacaggaauccagcgaacugucuucuuuguucuaaugaugcuggucgccccauccuacggaaugcgaugcgugggaguggggaacagagacuuuguggaaggagucucagguggagcaugggucgaucugguacuagaacauggaggaugcgucacaaccauggcccagggaaaaccaacccuggauuuugaacugaucaagacaacagccaaggaaguggcucugcuaagaaccuauugcauugaagccucgauaucaaacauaacuacggcaacaagauguccaacgcaaggagagcccuaucucaaagaggaacaagaucaacaguauauuugccggagagaugugguagacagaggguggggcaauggcuguggcuuguuuggaaaaggagggguugugacaugugcgaaguuuuuaugcuugggaaagauaacaggcaauuugguucaaauugagaaccuugaauacacagugguugugacaguccacaacggagacacccaugcaguaggaaaugacauauccaaccauggagugacagcaacgauaacuccuaggucaccaucaguagagguuaaauuaccggacuauggagaauuaacacuugacugugaacccagguccggaauugacuucaaugagaugauucuaaugaaaaugaaaaagaaaacguggcuugugcacaagcaauggguuuuggaucuaccucuaccaugggcagcaggggcagacacaucaaaaguucaguggaauuacaaagagagaauggugacauucaaggucccucaugccaagagacaggaugugacagugcuagggucucaggaaggagcuaugcauucugcccucaccggagcuacagaaguggauuccggugauggaaaccauauguuugcaggacaucuaaaguguaaaguucgcauggagaaauugagaaucaaaggaaugucauacacgaugugcucaggaaaguucucaauugacaaagagauggcagaaacacagcaugggacgacaguagugaaagucaaguacgaaggugcuggagcuccauguaaaguccccauagaaauaagagaugugaacaaggaaaaagugguugggcgcaucaucucauccaccccuuuugcugagcacaccaacaguguaaccaacauagaguuagaaccccccuuuggggacaguuacauaguaauagguguuggagacagugcauuaacucuucauugguucaggaaagggaguuccauuggcaagauguuugaguccacauauagaggugcaaagcgaauggccauucuaggugaaacagcuugggauuuugguucaguugguggacuauucacaucauugggaaaggcugugcaccagguuuuugguagcguguacacaacuauguuuggaggagucucauggaugguuagaauccuaaucgggcuccuaguguuguggauuggcacgaauucaagaaacacuucaauggcaaugacgugcauagcuauuggaggaaucacucuguuucuggguuucacaguucacgcagacauggguugugcggugucauggagugggaaagaauugaaauguggaagcggaauuuuuguaguugacaacgugcacaccuggacagaacaguacaaauuucaaccagaguccccagcaagacuagcgucugcaauauugaaugcucacaaagauggggucuguggaauuagaucaaccacgaggcuggaaaaugucauguggaagcaaauaaccaacgagcuaaacuauguucucugggaaggaggacaugaccucacuguaguggccggggaugugaaagggguguuaaccaaaggcaagagagcacucacaccuccagugaaugauuugaaauauucauggaagacauggggaaaagcgaaaaucuucacuccagaagcaagaaauagcacauuuuugauagacggaccagacaccucugaaugccccaaugaacgaagagcauggaacuuucuugagguagaagacuaugguuuuggcauguuuacgaccaacauauggaugaaauuucgagaaggaaguucagaggugugugaucacagguuaaugucggcggcaaucaaagaucagaaagcugugcaugcugacaugggcuauuggauugagagcucaaaaaaccagcccuggcagauagggaacgcuucccucauugaagugaaaacaugucuguggcccaagacccacacauuguggagcaauggaguguuggaaagccaaaugcucauuccaaaagcauaugcaggcccuuuuucacagcacaauuaucgccagggcuaugccacgcagaccauaggcccauggcacuugggcaaauuggagauagacuuuggagaaugccccggaacaacagucacaauucaggaggauuguaaccauagagguccaucuuugaggaccacuacugcaucuggaaaauuggucacgcaguggugcugccgcuccugcacgaugccucccuuaagguuuuugggagaggauggguguugguaugggauggaaauuagacccuuaagugaaaaagaagagaacauggucaaaucacagguaucggccggacaggguacaucagaaacuuucucuauggggcuguuaugccugaccuuguuuguggaagaaugcuugaggagaagagucacuaggaaacacaugauauugguuguggugaccacccuuugugccaucauccuaggaggucucacauggauggacuuacuacgagcucuuaucauguuaggggacaccaugucugguaggaugggaggacagauucaccuaaccauuauggcaguguucaagaugucaccaggauaugugcuggguguguuuuuaaggaaacucacuucgagagagacagcacuaauaguaauaggaauggccaugacaacagugcuuucaauuccacaugaccucauggaauucaucgauggaauaucacugggguuaaucuugcuaaaaaugguagcucauuuugacaacacccaagugggaaccuuagcccuuuccuugacuuucauaagaucaacaaugccauuggucauggccuggaggaccaucauggcuguguuguuuguggucacacuuauuccucuauguaggacaagcugucuucaaaagcagucccauuggguagaaauaacagcacucauccuaggagcccaggcucugccaguguaccuaaugacccucaugaaaggagccucaaaaagauccuggccucuuaacgagggcauaauggcuguggguuugguuagucucuuaggaagcgcccuuuuaaaaaaugaugucccucuggcuggcccaaugguggcgggaggcuuacuucuggcagccuacgugaugagugguagcucagcagaccugucacuagaaaaagccgccaaugugcauugggaugagauggcagacauaacaggcucaagcccaaucauagaagugaagcaggaugaagauggcuccuucuccauacgggaugucgaggaaaccaauaugauaacccuuuuggugaaacuggcacugauaacagugucaggucucuacccccuggcaauuccagucacaaugaccuuaugguacauguggcaggugaaaacgcaaagaucaggggcccuaugggacguccccucacccgcugcagcucagaaagccacacugacugaaggaguguacaggaucaugcagagaggguuguuugggaaaacccagguuggaguggggauacacauggaagguguauuucacacaauguggcaugugacaagaggaucagugaucugccaugagacugggagauuagagccgucuugggcugacgucaggaacgacaugauaucauacggugggggauggagacucggagacaaaugggacaaagaagaagauguucagguucuagccauagaaccaggaaaaaacccgaaacauguccaaacgaaacccggccuuuucaagacccuaacuggagaaauuggagcaguaacauuggauuucaaacccggaacgucuggcucucccaucauuaacaagaaaggaaaaguuaucggacucuauggaaauggagugguuaccaaaucaggugacuaugucagugccauaacgcaagccgaaagaauuggugacccagauuaugaaguggaugaggacaucuuccgaaagaaaagauugacuauaauggauuuacaccccggagccggaaagacaaaaagaauucucccaucaauagucagagaagccuuaaaaaggaggcuacgaaccuugauuuuggcccccacgagagugguggcggccgagauggaagaggcccuucguggacugccaauccguuaucagaccccagcugugaaaucagaacacacaggaagagaaauuguggaccucaugugccaugcaaccuucacagcaaauccuuugucaucaacuagaguuccaaauuacaaccuuauagugauggaugaagcacauuuacaggaccuuucuauugucgcggccagaggauacaucucaaccaggguggaaaugggagaggcggcagcuaucuuuaugacugccaccccuccaggagcgacagaccccuucccccagagcaacagcccaauagaagauaucgagagggaaauuccugaaaggucauggaauacaggguucgacuggauaacagacuaucaagggaaaacugugugguuuguucccaguauaaaagcuggaaaugacauugcaaauugcuugagaaagucgggaaagaaggugauccaguuaaguaggaaaacuuuugacacagaguacccaaaaacgaaacucacagacugggauuuuguggucaccacagacauaucugaaaugggggccaacuuuagagcaaggagagugauagaccccaggagaugccucaagccaguuauccuaacagauggaccagagagagucauuuuagcaggucccauuccagugacuccagcaagugcugcucagagaagagggcgaauaggcaggaacccagcacaagaagacgaccaauacgucuucuccggagacccacuaaaaaaugaugaagaucaugcccacuggacagaagcaaagaugcugcuugauaauaucuauaccccggaaggaaucauuccaacauuguuugguccagaaagggaaaaaauccaagccauugauggagaguuccgccucagaggggaacagaggaaaacuuuuguggaacuaaugaggagaggagaccuuccgguguggcugagcuauaagguggcuucugcugguauuucuuacaaagaccgggaauggugcuucacaggggaaagaaauaaccaaauuuuagaagaaaauauggagguugaaauuuggacuagagagggagaaaagaaaaaacuaaggccaaaaugguuagaugcacguguuuaugcugaccccauggcuuugaaggauuucaaggaguuugccagcggaagaaagagcauaacccuugacauccuaacagagauugccaguuugccaacuuaucuuuccucuagggcuaagcucgcucuugacaacauagucaugcuccacacaacagagagaggagggagggccuaccaacacgcccugaacgaacucccggagucacuggaaacacucaugcuaguagccuuacuaggugcuaugacagcaggcaucuuccuguuuuucaugcaaggaaaaggaauagggaaauugucaauggguuugauggccauugcgguagcuaguggcuugcucuggguagcagaaauucagccccaguggauagcggccucaaucauacuggaguuuuuuucuauggcacuguugauaccagaaccagaaaaacaaaggaccccacaagacaaucaauugaucuaugucauauugaccauucucaccauuauuggucucauagcagccaacgagauggggcugauugaaaaaacaaaaacggauuuuggguuuuaccagguaaaaacagaaaccaccauccucgauguagauuugagaccagcuucagcauggacgcucuaugcgguagccacuacuauuuugacuccuaugcugagacacaccauagaaaacacgucugcuaacuuaucucuagcggccauugccaaccaagcagcuguccuaauggggcuuggaaaaggauggccacuucacagaauggaccuuggugugccgcuguuggcaaugggauguuacucucaagugaacccaacaacucugacagcauccuuagucaugcuuucaguccauuaugcaauaauagguccaggacugcaggcaaaagccacaagagaggcucagaaaaggucagcugcugggaucaugaagaaccccacgguggacgggauaacaguaauagacuuagaaccaauauccuaugacccaaaauuugaaaagcaauuagggcaagucaugcuacuagcauugugugcuggacaacuacucuugaugagaacaacaugggcuuucugugaagucuugacuuuggccacaggaccaaucuugaccuugugggagggcaacccgggaagguuuuggaacacgacuauacccguauccacugccaauauuuucaggggaaguuacuuggcgggagcuggacuagcuuuuucgcucauaaagaacgcacaaacccccaggaggggaaccgggaccacaggagagacacugggagagaaguggaagagacagcuaaacucauuagacaggaaggaguuugaagaguacaaaagaaguggaauauuugaaguggacaggcacgaaaucaaauacaccuuaaaggauggguccaaaaucaaccaugccauguccacaggguccaucaagaucagagggauugaugaaagagggaugguaaaacccaaaggaaaaguuguggaccaagggugcgggagaggaggauggucccauuacacugcgacagcuaagaaagugacugaggugaaaggguacacaaaaggagguccaggacaugaagaaccgauucccauggcuaccuauggcuggaauuuggucaaacuccauucaggaguugacguguucuauaaacccacugagcaaguggacacccugcucugugacauuggggagucaucuuccaauccgacgauagaagaaggaagaacauugagaguuuugaagaugguggaaccauggcucucuucaaaaccugaauucugcaucaaaguccuuaaccccuacaugccaacagucauagaagagcuggagaaacuacagagaaaacaugguggaagucuugucagaugcccgcuauccaggaauucuacucaugagauguacugggugucaggugugucgggaaacaucgugagcucugugaacacaacaucaaagauguuguuaaacagguuuaccacaaggcacagaaaaccuacuuaugagaaggauguagaccuuggagcagggacgagaagugucuccauugagacagaaaaaccagacaugacgauuauugggagaaggcuucagcgguugcgagaagagcacaaagaaacuuggcacuacgaucaggaaaacccauacagaaccugggcguaucacggaagcuaugaagcuccuucgacaggcucagcauccuccauggugaacgggguaguaaaacugcugacaaagccuugggacguaauuccaauggugacccagcuagccaugacagacacaaccccuuuugggcaacagagagaguucaaagagaagguguauaccucuacaccccaccccaaaccuuggacacgaaugguuaugaccacaacagccaauuggcugugggcccucggugggaagaagaaaagucccagacugugcacaugggaagaguucaucucaaaaguuaggucaaacgcagccauaggcgcaguuuuucaagaagaacagggauggacaucagcuagugaagcugugaaugacagccgguuuugggaacugguugacaaagaaagggcucugcaccaggaagggaaaugugaaucguguguuuacaacaugaugggaaaacgugagaaaaagcuaggagaguuugguagagccaaaggaagccgagcaaucugguacauguggcugggagcgcgguuucuggaauuugaagcccuggguuuuuugaaugaagaucacugguuuggcagagaaaauucauggagugggguggaaggggaagguuugcauagauugggauauauccuggaggacauagacaagaaggauggagaccugauauaugcugaugacacagcagguugggacacaagaaucacugaagaugaccuucugaaugaagaacugaucacggaacagauggcuccucaucauaggauccuagccaaagccauuuucaaacuuacuuaucauagcaaagugaugaaaguccucagaccuacaccgaaaggagcgguaauggauaucauauccaggaaagaccaaagagguaguggacagguuggaacauaugguuugaacacauucaccaacauggaaguacaacucauccgccaaauggaagcugaaggagucauuacacaagaugacaugcagaacccaaaaggguugaaagaaagaguugagaaauggcugaaggaguguggugucgacagguuaaagaggauggcaaucaguggagacgauuguguggugaagccccuggacgagagguucagcacuucccuccucuuuuugaacgacaugggaaaggugaggaaagacauuccgcagugggaaccaucuaagggauggaaaaacuggcaagagguucccuuuugcucccaccacuuucacaagauuuucaugaaagauggccgcucacuaguuguuccauguagaaaccaggaugagcugauagggagagccagaaucucacagggggcuggauggaguuuaagagaaacagccugucugggcaaagcuuacgcccagauguggucgcucauguacuuucacagaagggaccugcguuuagccuccauggccauaugcucagcaguuccaacggaaugguucccaacaagcagaacaacauggucaauccacgcccaucaccaguggaugaccacugaagacaugcucaaaguguggaacagaguguggauagaagacaacccuaacaugacugacaagaccccaguccauucgugggaagacguaccuuaccuagggaaaagagaggacuugugguguggauccuugauuggacuuucuuccagagccaccugggcaaagaacauucacacagccauaacccaagucaggaaccugaucgggaaagaggaguauguagauuacaugccagucaugaaaagauacagcgcucccaucgagagugaaggaguucuguaa

SEQ ID NO: 7798 - RNA, 9867 nt, Artificial Sequence
  derived and/or modified CDS sequence (wt) from DENV-4__JQ922559__SS-prME
ucaacaauaacauuguugugcuugauucccaccguaauggcguuucacuugucaacgagagauggcgaaccccuuaugauaguggcgaaacacgaaagggggagaccucucuuguuuaagacaacagaaggaaucaacaagugcacucuuauugccauggaccugggugaaaugugcgaggacaccgucacguauaaaugcccuuuacuggucaauaccgaacccgaagacauugauugcuggugcaaucucacgucugccugggucauguaugggacaugcacccaaaguggggaacggagacgagagaagcgcucaguagcucuaacaccacauucaggaaugggauuggaaacaagggcugaaacauggaugucaucggaaggagcuuggaaacacgcucagaggguagagaguuggauacucagaaacccaggauucgcgcucuuggcaggauuuauggccuacaugauugggcaaacaggaauccagcgaacagucuucuuuauucuaaugaugcuggucgccccauccuacggaaugcgaugcguaggaguggggaacagagacuuuguggaaggagucucagguggagcaugggucgaucugguacuagaacauggaggaugcgucacaaccauggcccagggaaaaccaacccuggauuuugaacugaucaagacaacagccaaggaaguggcucuguuaagaaccuauugcauugaggcuucgauaucaaacauaacuacggcaacaagauguccaacgcaaggagagcccuaucucaaagaggaacaagaucaacaguauauuugccggagagaugugguagacagaggguggggcaauggcuguggcuuguuuggaaaaggaggaguugugacaugugcgaaguuuuuaugcucgggaaagauaacaggcaauuugguucaaauugagaaccuugaauacacagugguugugacaguccacaacggagacacccaugcaguaggaaaugacauauccauccacggagugacagcuacgauaacuccuaggucaccaucaguagaggucaaauuaccggacuauggagaauuaacacuugacugugaacccagguccggaauugacuucaaugagaugauucuaaugaaaaugaaaaagaaaacguggcuugugcacaagcaaugguuuuuggaucuaccucuaccauggacagcaggggcagacacaucagaaguucaguggaauuacaaagagagaauggugacauucaaggucccucaugccaagagacaggaugugacagugcuagggucucaggaaggagccaugcauucagcccucaccggagccacagaaguggauuccggugauggaaaccacauguuugcaggacauuugaagugcaaaguucguauggagaaauugaggaucaagggaaugucauacacgaugugcucaggaaaguucucaauugacaaagagauggcagaaacacagcaugggacaacagugguaaaagucaaguaugagggugcuggagcuccauguaaaguucccauagagauaagagaugugaacaaggaaaaagugguugggcguaucaucucaucuacuccuuuugcugagaacaccuacagugugaccaauauagaauuggaaccccccuuuggggauagcuacauaauaauagguguaggagacagugcauuaacacuccauugguucaggaaagggaguuccauuggcaagauguuugaguccacauacagaggcgcaaagcgcauggccauucuaggugaaacagcuugggauuuugguucuguugguggacugcucacaucauugggaaaggcuguacaccagguuuuugguaguguguauacaacuauguuuggaggagucucauggaugguuagaauccuaaucgggcucuuaguauuguggauuggcacgaauucaagaaacaccucaauggcaaugucgugcauagcuguuggaggaaucacuuuguuucuggguuucacaguucaugcagacauggguugugcggugucauggagugggaaagaauugaaauguggaagcggaauuuuuguaauugacaacgugcacacuuggacagaacaguacaaguuucaaccagagucaccagcgagacuggcgucagcaauacugaaugcccacaaagauggagucuguggaauuagaucaaccacgaggcuggaaaaugucauguggaagcaaauaaccaaugaguuaaacuauguccucugggaaggaggacaugaccucacuauaguggccggggacgugaaagggguguuguccaaaggcaagagagcccucgcaccuccagugaaugaccugaaauauucauggaagacauggggaaaggcaaagaucuucacuccagaaacaagaaacaguacauuuuuaauagacggaccagacaccuccgaaugccccaaugaacgaagagcauggaacuuucuugagguagaagacuauggauuuggcauguuuacgaccaacauauggaugaaauuucgagaaggaaguucagaagugugugaccacagguugaugucagcggcaaucaaagaccagaaagcugugcaugcugauaugggcuauuggauagagagcucaaaaaaccagaccuggcagauagagaaggcaucccucauugaagugaaaacaugccuguggcccaagacccacacauuguggagcaauggagugcuggaaagccagaugcucaucccaaaagcauaugcaggcccuuuuucacagcacaauuaccgccagggcuaugccacgcagaccgugggcccauggcacuugggcaaacuggagauagacuuuggagaaugccccggaacaacagucacuauucaagaggauugugaccauagaggcccgucucugaggaccaccacugcaucuggaaaacuggucacgcaguggugcugccgcuccugcacgaugccuccccuaagguuuuuaggagaggauggauguugguaugggauggaaauuaggcccuugagugaaagagaagagaacauggucaaaucacagguaucggccggacaggguacaucagaaacuuuuucuaugggguuguuaugcuugacuuuguuuguggaagaaugcuugaggagaagagucaccaggaaacacaugauauugguuguggugaccacccuuugugccaucaucuuaggaggucucacauggauggacuuacugcgagcccuuaucaugcuaggggacaccaugucuaguagaaugggaggacagauucaccuagccaucauggcaguguucaagaugucaccaggauacgugcuggguauauuuuugaggaaacucaccucaagagagacagcacuaaugguaauaggaauggccaugacaacggugcuuucaauuccacaugaccuuauggaauuuauugauggaauaucacuaggguugaucuuguuaaaaaugguaacacauuuugacaacacucaaaugggaaccuuggcccuuuccuugaccuucauaaaaucaacaaugccauuggucauggcuuggaggaccauaauggcuguguuguuuguggucacacucauuccucuaugcaggacaagcugucuucagaagcagucccauuggguggaaauaacagcacucauccugggagcccaggcucugccaguguaccuaaugacucucaugaaaggagccucaaagagauccuggccccuuaacgaggguauaauggcugugggcuuggucagucucuugggaagcgcccuucuaaagaaugaugucccuuuagcuggcccaaugguggcaggaggcuuacuucuggcagccuacgugaugagcggcagcucagcagaccugucacuagagaaggcugccaaugugcagugggaugagauggcagacauaacaggcucaagcccaaucauagaagugaagcaagaugaagauggcucuuucuccauacgagacguugaggaaaccaacaugauaacccuccuggugaagcuggcacugauaacagugucaggucucuaccccuuggcaauuccagucacaaugacccuaugguacauguggcaagugaaaacacaaagaucaggagcccugugggacguccccucaccugcugccgcucagaaagccacacugacugaaggaguguacaggaucaugcaaagaggguuguuugggaaaacucagguuggaguagggauacacauggaagguguauuucauacaauguggcauguaacaagaggaucagugauuugccaugagagugggagacuggagccaucuugggcugacgucaggaacgacaugauaucauacggugggggauggaggcucggagacaaaugggacaaagaagaagacguucaaguucuagcuauagaaccaggaaaaaauccgaaacauguccaaacgaaacccggccuuuucaaaacccuaacuggagaaauuggagcaguaacauuagacuucaaacccggaacauccgguucucccaucauuaacaggaaaggaaaaguuaucggacucuacggaaaugggguaguuaccaaaucaggugauuacgucagcgccauaacacaagcugaaagaauuggugagccagauuacgaaguggaugaggacaucuuucgaaagaaaagauuaacuauaauggacuuacaucccggagccggaaagacaaaaagaauucucccaucaauagucagagaggccuuaaaaaggaggcuacgaacccugauucuggcucccacgagagugguggcggccgaaauggaagaagcucuacguggacugccaauccguuaucagaccccagcuguguuaucagaacacacaggaagagagaucguagaccucaugugucaugcaaccuucacgacaagacuuuuaucaucaaccaggguuccaaauuacaaccuuauagugauggaugaagcgcauuucacagacccuucuagugucgcagcuagaggauacaucucaaccaggguggaaaugggagaggcugcagcuaucuucaugacugcaaccccuccuggaacaacagaucccuucccccagagcaacagcccaauagaagacaucgagagagaaauuccagaaaggucauggaacacaggguuugacuggauaacagacuaccaagggaaaacugugugguuuguucccagcauaaaagcuggaaaugacauugcaaauugcuugagaaaaucggggaagaaggugauccaauugaguagaaaaaccuuugacacggaguauccaaaaacgaaacucacggacugggauuuuguggucaccacagacauaucuguaaugggggccaauuuuagagcugggagagugauagaccccaggagaugccuuaagccaguuaucauaacugacgggccggagagaguuauuuuagcgggucccauuccagugacuccagcaagcgcugcucagagaagagggcgaauagguaggaacccagcacaagaagaugaccaauaugucuucuccggagacccacuaaggaaugaugaagaucaugcccacuggacugaagcaaagaugcuucuugacaauaucuacaccccagaagggaucauuccaacauuguuugguccggaaagggaaaaaacccaagccauugauggagaguuccgccucagaggggaacaaaggaagacuuuuguagaauuaaugaggagaggagaccuuccgguguggcugagcuacaagguagcuucugcugguaucucuuacaaagaccgggaauggugcuuuacgggggaaaggaacaaccaaauuuuagaagagaauauggagguugaaauuuggacuagagagggagagaagaaaaaacucaggccaaaaugguuagaugcacguguuuacgcugaccccauggcuuugaaggauuucaaggaguuugccaguggaagaaagagcauaacccucgacauccuaacagaaauugccaguuugccaacauaccuuuccucuagagcuaagcucgcccuugacaacauagucaugcuccacacaacagaaagaggagggaaggccuaucaacaugcccugaacgaacucccagagucacuagaaacacucaugcuuguagcuuuacuaggagccaugacagcaggcaucuucuuguucuucaugcaaggaaaaggaauaggggaauugucaauggguuugauagcuaucgcgggagcuaguggguugcucuggggaacaaaaacccccccccccuggggagcggccucaaauauacuggaguuuuuucucauggugcuguugauaccagaaccagaaaaacaaaggaccccacaagacaaccaauugaucuacguuauauugaccauucucacuauuauuggucucguggcagccaaugagauggggcuaauugaaaaaacaaaaacggauuuuggguuuuaccagguaaaaacagaaacuaccauucuugauguggacuugagaccagccucagcauggacgcucuaugcaguagccaccacuaucuugacucccaugcugagacacaccauagaaaacacgucugcaaaccuaucuuuagcggccauugccaaccaagcagccgucuugauggggcuuggaaaaggauggccgcuccacagaauggaccuuggugugccgcuauuggcaaugggaugcuauucccaagugaacccaacgacuuuaauagcauccuuagucaugcuuuuaguccauuaugcaauaauagguccaggauugcaggcuaaagccacaagagaggcucagaaaaggacagcugcugggaucaugaagaaccccacgguggacgggauaaccguuauagaucuagaacccauauccuaugacccaaaauuugaaaagcagcuagggcaagucauguuacuaguccugugugcuggacagcuacuccugaugagaacaacaugggccuucugugaagucuugacuuuggccacaggaccaaucuugacccugugggagggcaacccgggaagguuuuggaacacgacuauagccguguccacugccaacauuuucaggggaagcuauuuggcgggagcuggauuggccuuuucgcucauaaagaaugcacaaacacccaggaggggaacuggggucacaggagagacacugggagaaaaguggaagagacagcugaacucacuagauaggaaggaguuugaagaguacaaaagaaguggaauacuagaaguggacaggacugaagccaaaucugcccugaaagaugggucuaaaaucaagcaagcaguguccagagggaccagcaagauuagauggauuguugaaagagggaugguaaagccaaaagggaaaguuguggaccuugguugcgggagaggaggauggucguacuacauggcgacacucaagaacgugaccgaggugaaaggguacacaaaaggagguccaggacaugaagaaccaauucccauggcuacuuauggcuggaacuuggucaaacuccauucacggguugacguguucuacaaacccacugagcaaguggacacccugcucugugauauuggggagucauccucuaauccgacgauagaggaaggaagaacauuaagaguuuugaagaugguggagccauggcucucuucaaaaccugaauucugcaucaaaguccuuaaccccuacaugccaacagucauagaagagcuggagaaacugcagagaaaacaugguggaagucuugucagaugcccgcuauccaggaauuccacucaugagauguauugggugucaggugugucaggaaacauugugagcucugugaacacaacaucaaagauguuguugaacagauuuaccacaaagcauaggaaacccacuuaugagaaggacgcagaucuuggagcaggaacgagaagugucuccacugaaacggaaaaaccagacaugacaaucaucgggagaagacuccagcgauugcaagaagagcaccaagaaacuuggcacuaugaucaggaaaauccauacagaaccugggcguaucauggagguuaugaagcuccuucgacaggcucagcauccuccauggugaacgggguaguuaaacugcuaacaaaaccuugggacgugauuccaauggugacccaguuggcuaugacagacacaaccccuuuugggcaacagagaguguucaaagagaagguugacaccagaacaccacagccaaaacccgguacacgaaugguuaugaccacgacagccaacuggcugugggcucuccucgggaagaagaagaaucccagacugugcacaagggaagaguucaucucaaaaguuaggucaaaugcagccauaggcgcagucucucaggaagaacagggauggacgucauccuuugaagcugugaaugacagccgauuuugggaacugguugacaaagaaagggcucugcaccaggaagggaaaugugaaucaugugucuauaacaugaugggaaaacgugagaaaaaauuaggagaguuuggcagagccaagggaagccgggcaaucugguacauguggcugggagcgcgguuucuggaauuugaagcccugggguuucugaaugaagaucacugguuuggcagggaaaacucauggaguggaguggaaggggaaggucugcauagguugggauauauccuggaggacuuagauaaaagggauaggagccugguauuugcugaugacacagcugguugggacaccaagauucccgaagaugaccuucugaaggaaaaaccgaucccgggaccaauggccccucaucaaaggaucccagccagagccauuuucaaacuaacuuaucaaaacaaagugguaaaaguccucagacuuaaauugaaaggagcagugauggacaucauaucuaggaaagaacaaagagguaguggacagguuggaacauaugguuugaacacauucaccaauauggaaguacaacucauccgccaaauggaagcugaaggagucaucacacgagaugacaugcauaacccaaaaggguugaaagaaagagucgagaaauggcugaaagaguguggugucgacagguuagagaggauggcaaucaguggagaugauuguguggugaagccucuggaugagagguucagcacuucccuccucuuuuugaacgacaugggaaaggugaggaaagacauuccgcaaugggaaccauccaagggauggaaaaacuggcaagagguuccuuuuugcucccaccacuuucacaagaucuuuaugaaggauggccgcucacugguuguuccauguagaaaccaggaugaacugauagggagagccagaaucucgcaaggggcuggauggaguuuaagagaaacagccugucugggcaaggcuuacgcccagauguggucgcucauguacuuucauagaagggaccugcgcuuagccuccauggccauaugcucagcagucccaacggaaugguuuccaacaagcagaacaacauggucaauccacgcucaucaucaguggaugaccacugaagauaugcucaaaguauggaacagaguguggauagaagacaacccuaauaugacugacaagacuccaguucauucgugggaagacauaccuuaccuagggaaaagagaggauuugugguguggauccuugauuggacucucuucuagggccaccugggcgaagaacauucacacagccauaacucaggucaggaacuugaucgggauagagggguauguggauuacuuucuacucauaaaaugguacagcgcuccuuucgagagugaaggaguucuguaa

SEQ ID NO: 7799 - RNA, 9867 nt, Artificial Sequence
  derived and/or modified CDS sequence (wt) from DENV-4__KF955510__SS-prME
ucaacaauaacauugcugugcuugauuccuacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugcgaggacaccgucacguauaaaugccccuuacuggucaauaccgaacccgaagacauugauugcuggugcaaucucacgucugccuggguuauguaugggacaugcacccaaaguggagaacgaagacgagagaagcgcucaguagcucuaacaccacauucaggaaugggauuggaaacaaggacugaaacauggaugucaucggaaggggcuuggaaacacgcccagaggguagagaguuggauacucagaaagccaggauucgcgcucucggcagguuuuauggccuacaugaucgggcaaacaggaauacagcgaacagucuuuuucauucuaaugaugcuggucgccccaucuuacggaaugcgaugcguaggaguggggaacagagacuuuguagaaggagucucagguggagcaugggucgaucuggugcuagaacauggaggaugugucacaaccauggcccagggaaagccaaccuuggauuuugaacugaucaagacaacagccaaggaaguggcccuauuaagaaccuauugcauugaagcuuccauaucaaacauaaccacggcaacaagauguccgacgcaaggagagccuuaccucaaagaggaacaagaucaacaguacaucugccggagagauaugguagauagaggguggggcaacggcuguggcuuguuugggaaaggaggaguugugacaugugcgaaguuuucaugcucggggaaaauaacgggcaacuuaguccagauugagaaccuugaauacacagugguuguaacaguccacaauggagacacccaugcuguaggaaaugacacauccaaccacggagagacagcuacgauaacccccaggucaccaucgguugaaguuagacuaccagacuauggagaauugacacuugacugugaaccuagguccggaauugacuuuaaugagaugauucugaugaaaaugaaaacgaaaacguggcucgugcacaagcaaugguucuuggaucuaccucuaccauggacagcaggagcagacacgucagaaguucacuggaaucacaaagagagaauggugacauucaagguuccucaugccaagagacaggaugugacagugcuaggaucucaggaaggagccaugcauucagcccucgccggagccacagaaguggauuccggugauggaaaccauauguuugcaggacacuuaaaguguaaaguucguauggaaaaguugaggaucaagggaaugucauacacgaugugcucaggaaaguucucaauugauaaagagauggcagaaacacagcauggaacaacagugguaaaggucaaguaugaggguacuggagcuccauguaaaguucccauagagauaagagaugugaacaaggaaaaagugguugggcgcaucaucucauccaccccuuuugcugagaauaccaacagugugaccaauauagaauuggaaccuccuuuuggggauagcuacauagugauaggugcgggagacagugcauuaacacuccauugguucaggaaagggagcuccauugguaagauguuugaguccacauacagaggugcaaagcgcauggccauucuaggugaaacagccugggauuuugguucuguugguggacugcucacgucauuaggaaaggcuguacaccagguuuuuggcaguguguauacaaccauguuuggaggagucucguggauggucagaauccuaaucgggcucuuagugcuguggauuggcacgaauucaagaaacacuucgauggcuaugucgugcauaguuguuggaggaaucacccuguuucugggcuuuacaguucaugcagacauggguuguguggugucauggagugggaaagaguugaaauguggaagcggaauuuuuguaauugacaacgugcacacuuggacagaacaguacaaauuucaaccagagucuccagcgcgacuggcgucggcaauacugaaugcccacaaagauggggucuguggaauuagaucaaccacgaggcuggaaaaugucauguggaagcaaauaaccaaugaguuaaacuauguucucugggaaggaggacaugaccucaccguaguggccggggaugugaaagggguguuguccaaaggcaagagagcacucgcaccuccagugaaugaccugaaauacucauggaagacauggggaaaagcaaagaucuuuacuccagaaacaagaaacagcacauuuuugguggacggaccagacaccuccgaaugccccaaugaacgaagagcauggaacuuucuugagguggaagacuauggauuuggcauguucacgaccaacauauggaugaaauuucgagaaggaaguucagaagugugugaccacaggcugaugucggcggcaaucaaagaccagaaagcugugcaugcugacaugggcuauuggauagagagcucaaaaaaccagaccuggcagauagagaaggcaucccuuauugaagugaaaacaugucuguggcccaagacccacacauuguggagcaauggaguguuggaaagccagaugcucaucccaaaagcauaugcaggcccuauuucacagcacaacuaucgccagggcuaugccacgcagaccgugggcccauggcaccugggcaaauuggagauagauuuuggagagugccccggaacaacagucacuauucaagaggauugugaccauagagguccaucuuugaggaccaccacugcaucuggaaaauuggucacgcaguggugcugucgcuccugcacgaugccucccuuaagauucuuaggagaggauggaugcugguaugggauggaaaucaggcccuugaaugaaaaagaagagaacauggucaaaucacagguaucagccggacaggguacaucagagacuuuuucuauggggcuguuaugccugacuuuguuuguggaagaaugcuugaggagaagagucaccaggaaacacaugauauugguuguggugaccacccuuugugccaucauuuuaggaggucuuacauggauggacuuacugcgugcccuuaucaugcuaggggacaccaugucugguagaaugggaggacagauucaucuagccaucauggcaauguucaagaugucaccaggauacguguuggguauauuucugaggaaacucaccucaagagagacagcacuaaugguaauaggaauggccaugacaacggugcuuucaauuccacaugaccuuauggaauuuauugauggaauaucauuaggguuaaucuuacuaaaaaugguaacacauuuugacaacacucaagugggaaccuuagcccucuccuugaccuucauaaaaucaacaaugccauuggucauggcuuggaggaccauaauggcuguguuguuuguggucacacucauuccucuauguaggacaagcugucuucaaaagcagucucauuggguggaaauaacagcacucauccugggagcccaggcucugccaguauaccuaaugacucucaugaaaggagccucaaaaagaucuuggccccuuaacgaggguauaauggcugugggcuuggucagccucuuaggaagcgcccuucuaaagaaugaugucccuuuggcuggcccaaugguggcaggaggcuuacuucuggcagccuacgugaugagcggcagcucagcagaccugucacuagagaaggcugccaaugugcagugggaugagauggcagacauaacaggcucaagcccaaucauagaagugaagcaggaugaagauggcucuuucuccauacgggacgucgaggaaaccaacaugaucacccuccuggugaaacuggcacugauaacagugucaggucucuaccccuuggcaauuccagucacaaugaccuuaugguacauguggcaagugaaaacacaaagaucaggagcccugugggacguccccucaccugcugccgcucagaaagccacacuaacugagggagcauacaggaucaugcaaagaggguuguuugggaaaacucagguuggaguagggauacacauggaaggaguauuucauacaauguggcauguaacaagaggaucagugauuugccaugagagugggagacuggagccaucuugggcugacgucaggaacgacaugauaucauacggugggggauggaggcucggagacaaaugggauaaagaagaagauguccaaguucuagcuauagaaccaggaaaaaauccgaaacauguccaaacgaaacccggccuuuucaaaacccuuacuggagaaauuggagcaguaacauuggacuucaaacccggaacauccgguucucccaucauuaacaggaaaggaaaagucaucggacucuacggaaaugggguaguuaccaaaucaggugauuacguuagugccauaacacaagcugaaagaauuggugagccagauuaugaaguggaugaggacauuuuccgaaagaaaagauuaacuauaauggauuuacaucccggagccggaaagacaaaaagaauccucccaucaauaguuagagaagccuuaaaaaggaggcugcgaaccuugauucuggcucccacgagagugguagcggccgaaauggaagaagcgcuacguggacugccaauccguuaucagaccccagcugugaaaucagaacacacaggaagagagauuguagaccucaugugucaugcaaccuucacaacaagacuuuuaucaucaaccaggguuccaaauuacaaccucauagugauggaugaagcgcauuucacagacccuucuaguguugcagcuagagguuauaucucaaccaggguggaaaugggagaggcugcagcuaucuuuaugacugcaaccccuccuggaacgacagaucccuucccccagagcaacagcccaauagaagacaucgagagagaaaucccagaaaggucauggaacacaggguuugacuggauaacggacuaccaagggaaaacugugugguuuguucccagcauaaaagcuggaaaugacauugcaaauugcuugagaaaaucgggaaagaaggucauccaauugagcaggaaaaccuuugacacagaguauccaaaaacgaaacucacggacugggauuuuguggucaccacagacauaucugaaaugggggccaauuuuagagcugggagagugauagaccccaggagaugccucaagccaguaaucuuaacugaugggccagagagaguuauuuuagcgggucccauuccagugacuccagcaagcgcugcucagagaagagggcgaauagguaggaacccagcacaagaagaugaccaauaugucuucuccggagacccacuaaggaaugaugaagaucacgcccacuggacugaagcaaagaugcuucuugauaauaucuacaccccagaaggaaucauuccaacauuguuugguccagaaagggaaaaaacccaagccauugacggagaguuccgccucagaggggaacaaaggaagaccuuuguagaauuaaugaggagaggagaccuuccgguguggcugagcuacaagguagcuucugcuggcaucucuuacaaagaccgggaguggugcuucacgggggaaaggaauaaccaaaucuuagaagaaaacauggagguugaaauuuggacuagagagggagagaagaaaaaacucaggccaaaaugguuagaugcacguguuuacgcugaucccauggcuuugaaggauuuuaaggaguuugccaguggaagaaagaguauaacccucgacaucuuaacagaaauugccaguuugccaacguaccuuuccucuagggcuaagcucgcccuugacaacauagucaugcuccacacaacagaaagaggagggaaggccuaccaacacgcccugaacgaacucccagagucacuagaaacacucaugcuuguagcuuuauugggagccaugacagcgggcaucuuccuauucuucaugcaaggaaagggaaugggaaaauugucaauggguuugauagccauugcgguagcuaguggcuugcuuuggguagcagaaauccagccccaguggauagcggccucaaucauauuggaguuuuuucucauggugcuguugguaccagaaccagaaaaacaaaggaccccacaagacaaucaauugaucuacgucauauugaccauucucaccaucauugcucucguggcagccaaugagauggggcuaauugaaaaaacaaaaacggacuuuggguuuuaccaggcaaaaacagaaaccaccauccuugauguggacuugagaccagcuucagcauggacgcucuaugcaguagccaccacuaucuugacucccaugcugaggcacaccauagaaaacacgucugcaaaccuaucuuuggcggccauugccaaccaagcagccgucuuaauggggcuuggaaaaggauggccgcuccacagaauggaccucggugugccgcuauuggcaaugggaugcuauucccaagugaacccaacgacuuugacagcauccuuagucaugcuucugguccauuaugcaauaauagguccaggauugcaggccaaagccacaagagaggcucaaaaaaggacagcugcugggaucaugaagaaccccacaguggacgggauaacaguuauagaucuagaaccaauuuccuaugacccaaaauuugaaaagcagcuggggcaagucaugcuacuaguucugugcgcuggacagcuacucuugaugagaacaacaugggccuucugugaagucuugacuuuggccacaggaccaaucuugaccuugugggaaggcaacccggggagguuuuggaacacgaccauagccguguccacugccaacauuuucaggggaagcuaccuggcgggagcuggauuggccuuuucgcuuauaaagaaugcacaaaccccuaggaggggaacugggaccacaggagagacacugggagaaaaauggaagagacagcuaaauucgcuagauaggaagggguuugaagaguacaaaagaaguggaauacuagaaguggacaggacugaagccaagucugcccuaaaagaugggucuaaaaucaaguaugcaguguccagagggacuagcaagauuagauggauuguugaaagagggaugguaaagccaaaagggaaaguuguggaucuugguugcgggagaggaggauggucguacuauauggcgacacucaagaacgugaccgaggugaaaggauauacaaaaggagguccaggacaugaggaaccgauucccauggcuaccuauggcuggaacuuggucaaacuccauucagggguugacguguucuacaaacccacugagcaaguggacacccugcucugugauauuggggagucaucuucuaauccgacgauagaggaaggaagaacauuacgaguuuuaaagaugguggagccauggcucucuucaaaaccugaauuuugcaucaaaguccucaaucccuauaugccaacaguuauagaggagcuggagaaacugcagagaaaacaugguggaagucuugucagaugcccgcuauccaggaacuccacccaugagauguauugggugucaggugugucaggaaacaucgugaguucugugaacacaacaucaaagauguuguugaacagauuuaccacaaggcacaggaaacccacuuaugagaaggacgcagaccuuggagcaggaacgagaagugucuccaccgaaacagaaaaaccagacaugacaaucaucgggagaagacuccagcgauugcaagaagagcacaaagaaacuuggcacuaugaucaugaaaauccauacagaaccugggcguaucauggaagcuaugaagccccuucgacaggcucagcauccuccauggugaacgggguaguuaaacugcugacaaaacccugggacgugguuccaauggugacccaguuggccaugacagacacaaccccuuuugggcaacagagaguguucaaagagaagguugacaccagaacaccacagccaaaacccgguacacgaguggucaugaccacgacagccaacuggcugugggcucuccucgggaggaagaaaaaucccagacugugcacaagggaagaauucaucucaaaaguuaggucaaaugcagccauaggcgcagucuuucaggaagaacagggauggacaucagccagugaagcugugaaugacagccgauuuugggaacugguugacaaagaaagggcuuugcaccaggaagggaaaugugaaucaugugucuauaacaugaugggaaaacgugagaaaaaguuaggagaauuuggcagagccaagggaagccgagcaaucugguacauguggcugggagcgcgguuucuggaauuugaagccuugggcuuucugaaugaagaucacugguuuggcagggaaaacucauggaguggaguggaaggggaaggucugcauagguugggauauaucuuggaggacauagauaagaaggauggagaucuuauauaugcugaugacacagcaggcugggacacaagaaucacugaagaugaccuucugaaugaagagcugaucacggaacagauggccccucaucauaaaauccuagccaaagccauuuucaaacuaacuuaucaaaacaaaguggugaaaguccucagacccacaccgaaaggagcagugauggacauuauauccaggaaagaucaaagagguaguggacagguuggaacauaugguuugaacacauucacuaacauggaagugcaacucauccgccaaauggaagcugaaggagucaucacacgagaugacaugcauaacccaaaagguuugaaagaaagaguugagaaauggcugaaagaguguggugucgacagguuaaagaggauggcaaucaguggagacgauuguguggugaagccuuuggaugagagguucagcacuucccuccucuuuuugaacgacaugggaaaagugaggaaagacauuccgcaaugggaaccauccaagggguggaaaaacuggcaagagguucccuuuugcucccaccacuuucacaagaucuuuaugaaggauggccguucacuggucguuccauguagaaaccaggaugaacuaauagggagagcuaggauuucgcaaggggcuggauggaguuuaagagaaacagccugucugggcaaagcuuacgcccagauguggucgcucauguacuuucauagaagggaccuacguuuagccuccauggcuauaugcucagcagucccaacggaaugguuuccaacaagcagaacaacauggucaauccacgcucaucaucaguggaugacuacugaagauaugcucaaaguguggaacagaguguggauagaagacaaccccaauaugauugacaaaacuccaguucacucgugggaagacauaccuuaccuagggaaaagagaggauuugugguguggauccuugauuggacucucuucuagggccaccugggcuaagaacauucacacagccauaacccaggucaggaaccugaucgggaaagaggaguauguggauuacaugccagucaugaaaagauacagcgcucauuucgagagugaaggaguucuguaa

SEQ ID NO: 7800 - RNA, 9867 nt, Artificial Sequence
  derived and/or modified CDS sequence (wt) from DENV-4__GQ868594__SS-prME
ucaacaaugacauugcugugcuugauucccaccguaauggcguuucacuugucaacaagagauggcgaaccccuuaugauaguggcaaaacacgaaagggggagaccucucuuguuuaagacaacagagggaaucaacaaaugcacucuuauugccauggaccugggugaaaugugugaggacaccgucacguaugaaugcccucuacuggucaauaccgaaccugaggacauugauugcuggugcaaucucacgucugccugggucauguaugggacaugcacucagaguggggaacggagacgggagaagcgcucaguagcccuaacaccacauucaggaaugggauuggagacaagggcugagacauggaugucaucggaaggggcuuggaaacaugcucagaggguagagaguuggauacucagaaacccaggauucgcucucuuggcaggauuuauggccuauaugauugggcaaacaggaauccagcgaacagucuucuuuguucuaaugaugcuggucgccccauccuacggaaugcgaugcgugggaguggggaacagagacuuuguggaaggagucucagguggagcaugggucgauuuggugcuagaacauggaggaugugucacaaccauggcccagggaaaaccaaccuuggauuuugaacugaucaagacaacagccaaggaaguggcucuguuaagaaccuauugcauugaagccucgauaucaaacauaaccacggcaacaagauguccaacgcaaggagaaccuuaucucaaagaggaacaagaucaacaguacauuugccggagagaugugguagacagaggguggggcaauggcuguggcuuguuugggaaaggaggaguugugacaugugcgaaguuuucaugcucggggaagauaacaggcaauuugguccaaauugagaaccuugaauacacaguaguuguaacaguccacaauggagacacccaugcaguaggaaaugacauacccaaccauggagugacagccacgauaacccccaggucaccaucgguagaaguuaaauuaccggauuauggagaauuaacacucgauugugaacccagguccggaauugauuuuaaugagaugauucugaugaaaaugaaaaagaaaacguggcuugugcacaagcaaugguuuuuggaucuaccucuaccaugggcagcaggagcagacacaucagaaguucauuggaauuacaaagagagaauggugacauucaagguuccucaugccaagagacaggaugugauagugcuaggaucucaggaaggagccaugcauucugcccucaccggagcuacagaaguggauuccggugauggaaaccacauguuugcaggacaucugaaaugcaaaguucgcauggagaaauugagaauuaagggaaugucauacacgaugugcucaggaaaguucucaauugacaaagagauggcagaaacacagcaugggacaacagugguaaaagucaaguaugagggugcuggagcuccauguaaaguucccauagagauaagagaugugaacaaggaaaaagugguagggcgcaucaucucaucuaccccuuuugcugaguauaccaacaguguaaccaacauagaauuagaaccccccuuuggggacagcuacauaguaauagguguuggagacagugcauuaacacuccauugguucaggaaagggaguuccauuggcaagaugcuugaguccacauacagaggcgcaaagcgaauggccauucuaggugaaacagccugggauuuugguucuguugguggacugcucacaucauugggaaaggcuguacaccagguuuuugguaguguguauacaacuauguuuggaggagucucauggaugguuagaauccuaauuggguucuuaguguuguggauuggcacgaauucgagaaacaccucaauggcaaugacgugcauagcuguuggaggaaucacucuguuucuggguuucacaguucacgcagacacggguugugcggugucauggagugggaaagaauugaaauguggaagcggaaucuuuguaauugacaacgugcacacuuggacagaacaguacaaauuucaaccagagucuccagcgagacuagcguccgcaauauugaaugcccacaaagauggggucuguggaauuagaucaaccacgaggcuggaaaacaucauguggaagcaaauaaccaacgaguugaacuauguucucugggaaggaggacaugaccucacuguaguggcuggggaugugaaaggggugcuguccaaaggcaagagagcacucgcacccccagugaaugaucugaaauauucauggaagacauggggaaaagcaaagaucuuuacuccagaagcaaaaaauagcacauuucuaauagacggaccagacaccuccgaaugccccaaugaacgaagagcauggaauuuucuugagguagaagacuauggauuuggcauguuuacgaccaacauauggaugaaauuucgagaaggaaguucagaagugugugaccacagguugaugucggcggcaaucaaagaccagaaagcugugcaugcugacaugggcuauuggauagagagcucaaaaaaccagaccuggcagauagagaaagcaucucucauugaagugaaaacaugucuguggcccaagacccacacauuguggagcaauggagugcuagagagccagaugcucaucccaaaagcauaugcaggcccuuuuucacagcacaauuaccgccagggcuaugccacgcagaccgugggcccauggcacuugggcaaauuggagauagacuuuggagaaugccccggaacaacagucacuauucaagaggauugugaccauagaggcccaucuuugaggaccacuacugcaucuggaaaauuggucacgcaguggugcugccgcuccugcacgaugccucccuuaagguuuuugggagaggauggaugcugguaugggauggaaauuaggcccuugagugaaaaagaagagaacauggucaaaucacagguaucggccggacaggguacaucagaaacuuuuucuauggggcuguuaugccugacuuuguuuguggaagaaugcuugaggagaagagucaccaggaaacacaugauauugguuguggugaccacccuuugugccaucauccuaggaggucucacauggauggacuuacuacgagcucuuaucauguuaggggacaccaugucugguagaaugggaggacagauucacuuagccaucauggcaguguucaagaugucaccaggauacgugcuggguauauuuuuaaggaaacucacuucaagagagacagcacuaauggugauaggaauggccaugacaacggugcuuucaauuccacaugaccuuauggaauucauugauggaauaucacugggguuaaucuuauuaaaaaugguaacacauuuugacaacacucaagugggaaccuuagcucuuuccuugacuuucauaagaucaacaaugccauuggucauggcuuggaggaccauaauggcuguguuguuuguggucacacucauuccuuuaugcaggacaagcugucuucaaaagcagucacauuggguagaaauaacagcacucauccugggagcccaggcucugccaguguaccuaaugacucucaugaaaggagcuucaaagagaucuuggccccuuaacgaggguauaauggcuguggguuuggucagucucuugggaagcgcccuccuaaagaaugaugucccuuuagcuggcccaaugguggcaggaggcuuacuucuggcagccuaugugaugagugguagcucagcagaccugucacuagagaaggccgccaaugugcagugggaugagauggcagacauaacaggcucaagcccaaucauagaagugaagcaggaugaagauggcucuuucuccauacgggacaucgaggaaaccaauaugauaacccucuuagugaaacuggcacugauaacagugucaggucucuaccccuuggcaauuccagucacaaugacccuaugguacauguggcaagugaaaacacaaagaucaggagcccugugggacguccccucaccugcugccgcucagaaagccacacugacugaaggaguguacaggaucaugcaaagaggguuguuugggaaaacucagguuggaguagggauacacauggaagguguauuucacacaauguggcauguaacaagaggaucagugaucugccaugagacugggagacuggagccaucuugggcugacgucaggaacgacaugauaucauacggugggggauggaggcucggagacaaaugggacaaagaagaagauguucagguucuagcuauagaaccaggaaaaaauccgaaacauguccaaacgaagcccggccuuuucaaaacccuaacuggagaaauuggagcagugacauuggacuucaaacccggaacauccgguucucccaucauuaacaggaaaggaaaaguuaucggacucuacggaaauggaguagucacuaaaucaggugauuacgucagugcuauaacgcaagccgaaagaacuggugagccagauuaugaaguggaugaggacauuuuucgaaagaaaagauuaacuauaauggacuuacaccccggagccggaaagacaaaaagaauucucccaucaauagucagagaagccuuaaaaaggaggcugcgaaccuugauuuuggcucccacgagagugguggcggccgagauggaagaggcccuacguggacugccaauccguuaucagaccccagcugugaaaucagaacacacaggaagagagaucguagaccucaugugucaugcaaccuucacaacaagacuuuuaucaucaaccaggguuccaaauuacaaccucauagugauggaugaagcacauuucacagacccuucuagugucgcggcuagaggauacaucucaaccaggguggaaaugggagaggcagcagccaucuuuaugacugcaaccccuccuggagcgacagaucccuucccccagagcaacagcccaauagaagacaucgagagagaaauuccagaaaggucauggaacacaggguucgacuggauaaccgacuaccaagggaaaacugugugguuuguucccagcauaaaagcuggaaaugacauugcaaauugcuugagaaagucgggaaagaaggugauccaauugaguagaaaaaccuuugacacagaguauccaaaaacgaaacuuacggacugggauuuugugguuaccacagacauaucagaaaugggggccaauuuuagagcugggagagugauagaccccaggagaugccucaagccaguuaucucaacugacgggccagagagaguuauuuuggcaggucccauuccagugacuccagcaagcgcugcucagagaagagggcgaauagguaggaacccagcacaagaagaugaccaauaugucuucuccggagacccacuaaaaaaugaugaagaucaugcccacuggacagaagcaaagaugcugcuugauaauaucuacaccccggaagggaucauuccaacauuguuugguccggaaagagaaaaaaaucaagccauugauggagaguuccgccucagaggggaacaaaggaagacuuuuguagaauuaaugaggagaggagaccuuccgguguggcugagcuacaagguagcuucugcugguaucucuuacaaagaccgggaauggugcuucacaggggaaaggaauaaccaaauucuagaagaaaacauggagguugaaauuuggacuagagagggagagaagaaaaaacucaggccaaaaugguuagaugcacguguuuacgcugaccccauggcuuugaaggauuucaaggaguuugccaguggaagaaagagcauaacccucgacauccuaacagagauugccaguuugccaacuuaccuuuccucuagggcuaagcucgcccuugacaacauagucaugcuccacacaacagaaagaggagggaaggccuaccaacaugcccugaacgaacucccggagucacuagaaacacucaugcuuguagcuuuacugggugcuaugacagcaggcaucuucuuguuuuucaugcaaggaaaaggaauagggaaacugucaauggguuugauagccauugcgguagcuaguggcuugcucuggguagcagaaauccagccccaguggauagcggccucaaucauacuagaguucuuucucaugguguuguugauaccagaaccagaaaaacaaaggaccccacaagacaaucaauugaucuacgucauauugaccauucucaccauuauuggucucauagcagccaacgagauggggcugauugaaaaaacaaaaacggauuuuggguuuuaccagguaaaaacagaaaccaccauccucgauguggauuugagaccagccucagcauggacgcucuaugcaguagccaccacuauucugacucccaugcugagacacaccauagaaaacacgucugcaaaccuaucucuagcggccauugcuaaccaagcagcuguccuaauggggcuuggaaaaggauggccgcuccacagaauggaccucggugugccgcuguuggcaaugggaugcuauucucaagugaacccaacgaccuugauagcauccuuagucaugcuuuuaguccauuacgcaauaauagguccaggacugcaggcaaaagccacaagagaggcucagaaaaggacagcagcugggaucaugaagaaccccacuguggacgggauaacaguaauagaucuagaaccaauauccuaugacccaaaauuugaaaagcaauuagggcaagucaugcuacuagucuugugugcuggacagcuacucuugaugagaacaacaugggcuuucugugaagucuugacuuuggccacaggaccagucuugacccugugggagggcaacccgggaagguuuuggaacacgacuauagccguguccacugccaauauuuucaggggaagcuacuuggcgggagcuggacuggccuuuucgcucauaaagaaugcacaaacccccaggaggggaacugggaccacaggagagacacugggagagaaguggaagagacagcuaaacucacuagauaggaaggaguuugaagaguacaaaagaaguggaauacuagaaguggacaggacugaagccaagucugccuugaaagauggaucuaaaaucaagcaugcaguguccagaggguccagcaagauuagauggauuguugaaagagggaugguaaaaccaaaagggaaaguuguggaucuugguugcgggagaggaggauggucguacuacauggcgacacucaagaacgugaccgaggugaaaggguacacaaaaggagguccaggacaugaagaaccgauucccauggcuaccuauggcuggaacuuggucaaacuccauucagggguugacguguucuacaaacccacugagcaaguggauacccugcucugugauauuggggagucaucuucuaauccgacgauagaggaaggaagaacauuaagaguuuugaagaugguggaaccauggcucucuucaaaaccugaauucugcaucaaaguccuuaaucccuacaugccaacagucauagaagagcuggagaaacugcagagaaaacaugguggaagucuugucagaugcccgcuaucuaggaauuccacucacgagauguauugggugucaggugugucgggaaacaucgugagcucuguaaacacaacaucaaagauguuguugaacagauuuaccacaaggcauagaaaacccacuuaugagaaggacguagaccuuggagcaggaacgagaagugucuccacugaaacagaaaaaccggacaugacaaucauugggagaaggcuucagcgacugcaagaagagcacaaagaaacuuggcacuaugaucaggaaaacccauacagaaccugggcguaucauggaagcuaugaagcuccuucgacaggcucagcauccuccauggugaacgggguaguaaaauugcugacaaaacccugggacgugauuccaauggugacccaguuggcuaugacagacacaaccccuuuugggcaacagagaguguuuaaagagaagguggacaccagaacaccacaaccaaaacccggcacacgaaugguuaugaccacgacagccaacuggcugugggcucuccucgggaagaagaaaaaucccagacugugcacaagggaagaguucaucucaaaaguuaggucaaacgcagccauaggcgcagucuuucaggaagaacagggauggacaucagccagugaagcugugaaugacagccgauuuugggaacugguugacaaagaaagggcucugcaccaggaagggaaaugugaaucgugugucuacaacaugaugggaaaacgugagaaaaaguuaggagaguuugguagagccaagggaagccgagcaaucugguacauguggcugggagcgcgguuucuggaauuugaagcccuggguuuuuugaaugaagaucacugguuuggcagagaaaacucauggaguggaguggaaggggaaggucugcauagauugggauauauccuggaggacauagacaagaaggauggagaccugauauaugcugaugacacagcugguugggacacaagaaucacugaagaugaccuucuaaaugaagaacugaucacggaacagauggccccucaccauaagauccuagccaaagccauuuucaaacuaacuuaucaaaacaaaguggugaaaguccucagacccacaccgaaaggagcggugauggauaucauauccaggaaagaccaaagagguaguggacagguuggaacauaugguuugaacacauucaccaacauggaaguacaacucauccgccaaauggaagcugaaggagucaucacacaagaugacaugcauaacccaaaaggguugaaagaaagaguugagaaauggcugaaagaguguggugucgacagguuaaagaggauggcaaucaguggagacgauuguguggugaagccucuggaugagagguucagcacuucccuccucuuuuugaacgacaugggaaaggugaggaaagacauuccgcagugggaaccaucuaagggauggaaaaacuggcaagagguuccuuuuugcucccaccacuuucacaagaucuucaugaaggauggccgcucacuaguuguuccauguagaaaccaggaugaacugauagggagagccagaaucucgcaaggggcuggauggaguuuaagagaaacagccugccugggcaaagcuuacgcccagauguggucgcucauguacuuucauagaagggaccugcguuuagccuccauggcgauaugcucagcaguuccaacagaaugguuuccaacaagcagaacaacauggucaauccacgcccaucaucaguggaugaccacugaagauaugcucaaaguguggaacagaguguggauagaagacaacccuaauaugacugacaagacuccaguucauucgugggaagacauaccuuaccuaggaaaaagagaagauuugugguguggauccuugauuggacuuucuuccagggccaccugggcgaagaacauucacacagccauaacccaggucaggaaccugaucgggaaagaggaguauguggauuacaugccagucaugaaaagauacagcgcuccuuucgagagugaaggaguucuguaa

SEQ ID NO: 7801 - RNA, 9867 nt, Artificial Sequence
  derived and/or modified CDS sequence (wt) from DENV-4__FJ024424__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccucaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaauugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacaaccacgauaacucccaggucaccaucgguggaagucaaauugccggacuauggagaacuaacacucgauugugaacccaggucuggaauugacuuuaaugagaugauccuaaugaaaaugaaaaagaaaacauggcucgugcauaagcaaugguuuuuagauuugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauugguaagauguuugaguccacauacagaggugcaaaacgaauggccauucuaggugaaacagcuugggauuuugguuccguugguggacuguucacaucauugggaaaagcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacgguucaagcggacauggguuguguggugucauggagugggaaagaguugaagugugggagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacuuuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcaaauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacuauucaggaggauugugaccauagaggcccaucucugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacaaguggcggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggguacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccugggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuacccuuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagcugaaagaauuggagagccagauuaugagguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccaguaacuccagcaagcgcugcucagagaagagggcgaauaggaaggaacccaacacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauucuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgccuugaacgaacuuccggagucacuggaaacacucaugcuuguagccuuacuaggugcuaugacagcaggcaucuuccuguuuuuuaugcaagggaaaggaauagggaaauugucaauggguuugauaaccauugcgguggcuaguggcuugcucuggguagcagaaauucaaccccaguggauagcggcuucaaucauacuggaguuuuuucucaugguacuguugauaccagaaccagaaaaacaaaggacuccacaagacaaucaauugaucuacgucauauugaccauucucaccauuauuggucuaauagcagccaacgagauggggcugauagaaaaaacaaaaacggauuuuggguuuuaccaaguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccgacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgcuaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucucggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggauaugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgggcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucucaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaauggaugaccacugaagacaugcucaaaguguggaacagaguguggauagaagacaaccccaauaugauugacaagaccccaguccauucgugggaagauauaccuuaccuagggaaaagggaggauuugugguguggaucccuaauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7802 - RNA, 9867 nt, Artificial Sequence
  derived and/or modified CDS sequence (wt) from DENV-4__EU854295__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaaacaugcucagagaguagagagcuggauacucagaaacccaggauuugcgcucuuggcaggauuuauggcuuauaugauugggcaaacaggaauccagcgaacuguuuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguggaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauugguaagauguuugaguccacauacagaggugcaaaacgaauggccauucuaggugaaacagcuugggauuuugguuccguugguggacuguucacaucauugggaaaagcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaauuacucuguuuuugggcuucacgguucaagcggacaugggguguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaccugaaauauucauggaagacauggggaaaagcaaaaaucuucaccccagaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagauuaaugucagcugcaauuaaagaucaaaaagcugugcaugcugacauggguuauuggauagagagcucaaaaaaccagaccuggcagauagagaaagcaucucuuauugaagugaaaacaugucuguggcccaagacccacacacuauggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggaccgggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggguacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaaaaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuacccuuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugcuauaacgcaagccgaaagaauuggagagccagauuaugagguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggcuucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaucagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaaaccaaaagggaaaguuguagaucuuggcugugggagaggaggauggucuuauuacauggcgacacucaagaacgugacugaagugaaaggguauacaaaaggagguccaggacaugaagaaccgauucccauggcuaccuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagagacauggcauuaugaucaggaaaacccauacagaaccugggcguaccauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgagugguuaugaccacgacagcuaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagcuauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacgcaagaugacaugcagaacccaaaaggguugaaagaaagaguugagaaauggcugagagaguguggugucgacagguuaaagagaauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucucaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaauggaugaccacugaagacaugcucaaaguguggaacagaguguggauagaagacaaccccaauaugauugacaagaccccaguccauucgugggaagauauacccuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7803 - RNA, 9867 nt, Artificial Sequence
  derived and/or modified CDS sequence (wt) from DENV-4__EU854296__SS-prME
ucaacaauaacauuguugugcuugauucccacuguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuauuggucaauaccgaaccugaagacauugauugcuggugcaaccucacgucuaccugggucauguauggaacaugcacccagaguggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcucuuggcaggauuuauggcuuacaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccugguguuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgacugugaacccaggucuggaauugacuuuaaugagaugauccuaaugaaaaugaaaaagaaaacauggcucgugcauaagcaaugguuuuuggauuugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguuuaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugaccugcauagcuguuggaggaaucacucuguuuuugggcuuuacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugcgaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuugguauguuuacgaccaacauauggaugaaauuccgagaaggaaguucagaagugugugaccacagguuaaugucagcugcaauuaaagaucagaaagcugugcaugcugacauggguuauuggauagagagcucaaaaaaccagacuuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaacccuagcucuuuccuugacuuucauaagaucaacaaugucauuggucauggcuuggaggaccauuauggcuguguuguuuguggucacacucauucccuugugcaggacaagcugucuucagaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagagggcuauucgggaaaacucagguuggaguagggauacacauggaagguguguuucacacaauguggcauguuacaagaggaucagugaucugccacgagacugggagauuggagccaucuugggcugacgucaggaaugacaugauaucauacgguggaggauggaggcuuggagacaaaugggacaaagaagaagacguucagguccucgcuauagaaccaggaaaaaaucccaaacauguccaaacgaaaccuggccuuuucaagaccuuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauacuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgacuaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugacacagaauauccaaaaacgaaacucacggacugggacuuuguggucacuacagauauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcaucucuuacaaagaucgggaauggugcuucacuggggaaagaaauaaccaaauuuuggaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaccaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccaucauuggucuaauagcagccaacgagauggggcugauagaaaaaacaaaaacggauuuuggguuuuaccaggcaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcucagaaaaggacagcugcuggaaucaugaaaaauccaacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuuaaccuugugggagggcaacccgggaagguuuuggaacacgaccauagccguauccaccgccaacauuuucaggggaaguuacuuggcgggagcuggauuggcuuuuucacucauaaagaaugcacaaaccccuaggaggggaacugggaccauaggagagacacugggagagaaguggaagagacagcuaaacucauuagacaggaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacagacccacagagcaaguggacacccugcucugugauauuggggagucaucuucuaauccaacaauagaggaaggaagaacauuaagaguucugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacucuacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaggagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaauuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaagggcugaaagaaagaguugagaaauggcugagagaguguggugucgacagguuaaagaggauggcaaucaguggagacgacugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacgacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauugggcuuucuuccagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7804 - RNA, 9867 nt, Artificial Sequence
  derived and/or modified CDS sequence (wt) from DENV-4__GQ199878__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccucaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucagaaaccugaucggaaaagaggaauacguggauuacaugccaguaaugaaaagauacagugcuccuucagagagugaaggaguucuguaa

SEQ ID NO: 7805 - RNA, 9867 nt, Artificial Sequence
  derived and/or modified CDS sequence (wt) from DENV-4__GQ199879__SS-prME
ucaacgauaacauuacugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacuguuacguauaaauguccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggggagcccuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaaucugguccaaauugagaaccuugaguacacagugguuguaacaguccacaauggagacacccaugcaguaggaaaugacacauccaaucauggaguuacagcuacgauaacucccaggucaccaucgguggaagucaaauugccggacuauggagaacuaacacucgacugugaacccaggucuggaauugacuuuaaugagaugauucuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggaaaaauugagaaucaagggaaugucauacacgauguguucaggaaaguucucaaucgacaaagagauggcagaaacacagcaugggacaacaguggugaaagucaaguaugaaggugcuggagcuccguguaaaguccccauagagauaagagauguaaacaaggaaaaagugguugggcgcgucaucucauccaccccuuuggcugagaacaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugguuagaauccuaauuggguucuuaguguuguggauuggcacaaacucaaggaauacuucaauggcuaugacgugcauagcuguuggagguaucacucuguuucugggcuucacaguucaagcggacauggguugugugguaucauggagugggagagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguccucugggaaggaggacacgaucucacuguaguggcuggggaugugaaggggguguugacuaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagccgcaauuaaagaucagaaagcugugcaugcugacauggguuauuggauagagagcucaaaaaaccagaccuggcagauagagaaagcaucucuuauugaggugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaauuagagauagacuucggagaaugccccggaacaacagucacaauucaggaggauugugaccauagaggcccaucuuugaggaccaccacugcaucuggaaaacuagucacgcaguggugcugccgcuccugcacgaugccucccuuaagguucuugggagaagaugggugcugguauggaauggagauuaggccuuugaaugaaaaagaagagaacauggucaaaucacaggugacggccggacagggcacaucagaaacuuuuucuaugggacuguugugccugaccuuguuuguggaagaaugcuugaggagaagaguuacuaggaaacacaugauauuaguuguggugaucacucuuugugcuaucauccugggaggccucacauggauggacuuacuacgagcccucaucauguuaggggacacuaugucugguagaauaggaggacagauccaccuagccaucauggcaguguucaagaugucaccaggauacguacuggguguguuuuuaaggaaacucacuucaagagagacagcacuaaugguaauaggaauggccaugacaacgguacuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagccucuuaggaagcgcucuuuuaaaaaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacaguaucaggucucuacccccuggcaauuccagucacaaugaccuugugguacauguggcaagugaaaacacaaagaucaggagcccugugggacguccccucacccgcugccacucaaaaagcugcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuggauuucaaacccggcacgucugguucucccaucaucaacaggaaaggaaaagucaucggacucuauggaaauggagugguuaccaaaucaggcgauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcuccaacgagagugguggcggccgagauggaagaggcccuacguggacugccaauccguuaucagacuccagcugugaaaucagaacacacaggaagagagauuguagaccucaugugucaugcaaccuucacaacaagacuuuugucaucaaccaggguuccgaauuacaaccuuauagugauggaugaagcacauuucaccgauccuucuaguguugcggcuaggggauacauuucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagugcugcucagagaagagggcgaauaggaaggaacccagcacaagaagacgaccaauacguuuucuccggagauccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugagcuacaagguagcuucugcuggcauuucuuauaaagaucgggaauggugcuucacaggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacgcucaugcuuguagcuuuacuaggugcuaugacagcagguaucuuccuguuuuucaugcaagggaaaggaauagggaaauugucaauggguuugauagccauugcgguggcuaguggcuugcucuggguagcagaaauucaaccccaguggauagcggccucaaucauacuagaguuuuuucucaugguacuguugauaccagaaccagaaaaacaaaggacuccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauccugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuugguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugaggacaacaugggcuuucugugaagucuugacuuuggccacaggaccaaucuugaccuugugggaggguaacccgggaagguuuuggaacacgaccauagccguauccaccgccaacauuuucaggggaaguuacuuggcgggggcuggacuggcuuuuucacucauaaagaaugcacaaaccccuaggaggggaacugggaccacaggagagacacugggagagaaguggaagagacagcuaaacucauuagacagaaaagaguuugaagaguacaaaagaaguggaauacuagaaguggacaggacugaagccaagucagcccugaaagauggaucuaaaaccaagcaugcaguaucuagaggguccaguaagaucagauggauuguugagagagggaugguaaagccaaaagggaaaguuguagaucuuggcugugggagaggagguuggucuuauuacauggcgacacucaagaacgugacugaagugaaaggguauacaaaaggagguccaggacaugaagagccgauucccauggcuacuuauggcuggaauuuggucaaacuccauucagggguugacguguucuacaaacccacagaacaaguggacacccugcucugugauauuggggagucaucuucuaauccaacaauagaggaaggaagaacauuaagaguuuugaagaugguggagccauggcucucuucaaaaccugaauucuguaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacggaaaaaccagacaugacaaucauugggagaaggcuucagcgauugcaagaagagcacaaagaaaccuggcauuaugaucaggaaaacccauacagaacuugggcguaucauggaagcuaugaagcuccuucgacaggcucugcauccuccauggugaacgggguagugaaacugcuaacaaaacccugggaugugauuccaauggugacucaguuagccaugacagauacaaccccuuuugggcaacaaagaguguucaaagagaagguggauaccagaacaccacaaccaaaacccggcacacgaaugauuaugaccacgacagccaauuggcugugggcucuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacuggucgauaaagaaagggcccuacaccaggaagggaaaugugaaucgugugucuacaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauuggguuauauccuggaggagauagacaagaaggauggagaccuaauguaugcugaugacacagcaggcugggacacaagaauuacugaggaugaccuucaaaaugaagaacugaucacggaacagauggcuccccaccacaagauccuagccaaagcuauuuucaaacuaaccuaucaaaauaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaagauggccgcucacuagucguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaauccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7806 - RNA, 9867 nt, Artificial Sequence
  derived and/or modified CDS sequence (wt) from DENV-4__GQ199880__SS-prME
ucaacgauaacauuacugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacuguuacguauaaauguccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggggagcccuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaaucugguccaaauugagaaccuugaguacacagugguuguaacaguccacaauggagacacccaugcaguaggaaaugacacauccaaucauggaguuacagcuacgauaacucccaggucaccaucgguggaagucaaauugccggacuauggagaacuaacacucgacugugaacccaggucuggaauugacuuuaaugagaugauucuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggaaaaauugagaaucaagggaaugucauacacgauguguucaggaaaguucucaaucgacaaagagauggcagaaacacagcaugggacaacaguggugaaagucaaguaugaaggugcuggagcuccguguaaaguccccauagagauaagagauguaaacaaggaaaaagugguugggcgcgucaucucauccaccccuuuggcugagaacaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauuuuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacaaacucaaggaauacuucaauggcuaugacgugcauagcuguuggagguaucacucuguuucugggcuucacaguucaagcggacauggguugugugguaucauggagugggagagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguccucugggaaggaggacacgaucucacuguaguggcuggggaugugaaggggguguugacuaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagccgcaauuaaagaucagaaagcugugcaugcugacauggguuauuggauagagagcucaaaaaaccagaccuggcagauagagaaagcaucucuuauugaggugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaauuagagauagacuucggagaaugcccuggaacaacagucacaauucaggaggauugugaccauagaggcccaucuuugaggaccaccacugcaucuggaaaacuagucacgcaguggugcugccgcuccugcacgaugccucccuuaagguucuugggagaagaugggugcugguauggaauggagauuaggccuuugaaugaaaaagaagagaacauggucaaaucacaggugacggccggacagggcacaucagaaacuuuuucuaugggacuguugugccugaccuuguuuguggaagaaugcuugaggagaagaguuacuaggaaacacaugauauuaguuguggugaucacucuuugugcuaucauccugggaggccucacauggauggacuuacuacgagcccucaucauguuaggggacacuaugucugguagaauaggaggacagauccaccuagccaucauggcaguguucaagaugucaccaggauacguacuggguguguuuuuaaggaaacucacuucaagagagacagcacuaaugguaauaggaauggccaugacaacgguacuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagccucuuaggaagcgcucuuuuaaaaaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacaguaucaggucucuacccccuggcaauuccagucacaaugaccuugugguacauguggcaagugaaaacacaaagaucaggagcccugugggacguuccuucacccgcugccacucaaaaagcugcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuggauuucaaaccuggcacgucugguucucccaucaucaacaggaaaggaaaagucaucggacucuauggaaauggagugguuaccaaaucaggcgauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcuccaacgagagugguggcggccgagauggaagaggcccuacguggacugccaauccguuaucagacuccagcugugaaaucagaacacacaggaagagagauuguagaccucaugugucaugcaaccuucacaacaagacuuuugucaucaaccaggguuccgaacuacaaccuuauagugauggaugaagcacauuucaccgauccuucuaguguugcggcuaggggauacauuucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagugcugcucagagaagagggcgaauaggaaggaacccagcacaagaagacgaccaauacguuuucuccggagauccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugagcuacaagguagcuucugcuggcauuucuuauaaagaucgggaauggugcuucacaggggaaagaaauaaccaaauuuuagaagaaaacauggagguugaaauuuggacuagagagggagaaaagaaaaaacugaggccaagaugguuagaugcacguguauacgcugaccccauggcuuugaaggacuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacgcucaugcuuguagcuuuacuaggugcuaugacagcagguaucuuccuguuuuucaugcaagggaaaggaauagggaaauugucaauggguuugauagccauugcgguggcuaguggcuugcucuggguagcagaaauucaaccccaguggauagcggccucaaucauacuagaguuuuuucucaugguacuguugauaccagaaccagaaaaacaaaggacuccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauccugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuugguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugaggacaacaugggcuuucugugaagucuugacuuuggccacaggaccaaucuugaccuugugggaggguaacccgggaagguuuuggaacacgaccauagccguauccaccgccaacauuuucaggggaaguuacuuggcgggggcuggacuggcuuuuucacucauaaagaaugcacaaaccccuaggaggggaacugggaccacaggagagacacugggagagaaguggaagagacaacuaaacucauuagacagaaaagaguuugaagaguacaaaagaaguggaauacuagaaguggacaggacugaagccaagucagcccugaaagauggaucuaaaaccaagcaugcaguaucuagaggguccaguaagaucagauggauuguugagagagggaugguaaagccaaaagggaaaguuguagaucuuggcugugggagaggagguuggucuuauuacauggcgacacucaagaacgugacugaagugaaaggguauacaaaaggagguccaggacaugaagagccgauucccauggcuacuuauggcuggaauuuggucaaacuccauucagggguugacguguucuacaaacccacagaacaaguggacacccugcucugugauauuggggagucaucuucuaauccaacaauagaggaaggaagaacauuaagaguuuugaagaugguggagccauggcucucuucaaaaccugaauucuguaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacuacaaggcauaggaaacccacuuaugagaaggacguagaucuuggggcaggaacgagaagugucucuacugaaacggaaaaaccagacaugacaaucauugggagaaggcuucagcgauugcaagaagagcacaaagaaaccuggcauuaugaucaggaaaacccauacagaacuugggcguaucauggaagcuaugaagcuccuucgacaggcucugcauccuccauggugaacgggguagugaaacugcuaacaaaacccugggaugugauuccaauggugacucaguuagccaugacagauacaaccccuuuugggcaacaaagaguguucaaagagaagguggauaccagaacaccacaaccaaaacccggcacacgaaugauuaugaccacgacagccaauuggcugugggcucuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacuggucgauaaagaaagggcccuacaccaggaagggaaaugugaaucgugugucuacaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauuggguuauauccuggaggagauagacaagaaggauggagaccuaauguaugcugaugacacagcaggcugggacacaagaauuacugaggaugaccuucaaaaugaagaacugaucacggaacagauggcuccccaccacaagauccuagccaaagcuauuuucaaacuaaccuaucaaaauaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaagauggccgcucacuagucguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaauccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7807 - RNA, 9867 nt, Artificial Sequence
  derived and/or modified CDS sequence (wt) from DENV-4__GQ252675__SS-prME
ucaacgauaacauuacugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacuguuacguauaaauguccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggggagcccuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaaucugguucaaauugagaaccuugaguacacagugguuguaacaguccacaauggagacacccaugcaguaggaaaugacacauccaaucauggaguuacagcuacgauaacucccaggucaccaucgguggaagucaaauugccggacuauggagaacuaacacucgacugugaacccaggucuggaauugacuuuaaugagaugauucuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaauccguauggaaaaauugagaaucaagggaaugucauacacgauguguucaggaaaguucucaaucgacaaagagauggcagaaacacagcaugggacaacaguggugaaagucaaguaugaaggugcuggagcuccguguaaaguccccauagagauaagagauguaaacaaggaaaaagugguugggcgcgucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuaggauccuaauuggguucuuaguguuguggauuggcacaaacucaaggaauacuucaauggcuaugacgugcauagcuguuggagguaucacucuguuucugggcuucacaguucaagcggacauggguugugugguaucauggagugggagagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguccucugggaaggaggacacgaucucacuguaguggcuggggaugugaaggggguguugacuaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaggugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaauuagagauagacuucggagaaugccccggaacaacagucacaauucaggaggauugugaccauagaggcccaucuuugaggaccaccacugcaucuggaaaacuagucacgcaguggugcugccgcuccugcacgaugccucccuuaagguucuugggagaagaugggugcugguauggaauggagauuaggccuuugaaugaaaaagaagagaacauggucaaaucacaggugacggccggacagggcacaucagaaacuuuuucuaugggacuguugugccugaccuuguuuguggaagaaugcuugaggagaagaguuacuaggaaacacaugauguuaguuguggugaucacucuuugugcuaucauccugggaggccucacauggauggacuuacuacgagcccucaucauguuaggggacacuaugucugguagaauaggaggacagauccaccuagccaucauggcaguguucaagaugucaccaggauacguacuggguguguuuuuaaggaaacucacuucaagagagacagcacuaaugguaauaggaauggccaugacaacgguacuuucaauuccacaugaccuuauggaacucauugauggaauaucauugggacuaauuuugcuaaaaacaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagccucuuaggaagcgcucuuuuaaaaaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacaguaucaggucucuacccccuggcaauuccagucacaaugaccuugugguacauguggcaagugaaaacacaaagaucaggagcccugugggacguccccucacccgcugccacucaaaaagcugcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuggauuucaaacccggcacgucugguucucccaucaucaacaagaaaggaaaagucaucggacucuauggaaauggagugguuaccaaaucaggcgauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcuccaacgagagugguggcggccgagauggaagaggcccuacguggacugccaauccguuaucagacuccagcugugaaaucagaacacacaggaagagagauuguagaccucaugugucaugcaaccuucacaacaagacuuuugucaucaaccaggguuccgaauuacaaccuuauagugauggaugaagcacauuucaccgauccuucuaguguugcggcuaggggauacauuucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagugcugcucagagaagagggcgaauaggaaggaacccagcgcaagaagacgaccaauacguuuucuccggagauccacuaaaaaaugaugaagaucaugcccacuggacagaagcaaagaugcugcuugacaauauuuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugagcuacaagguagcuucugcuggcauuucuuauaaagaucgggaauggugcuucacaggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacgcucaugcuuguagcuuuacuaggugcuaugacagcagguaucuuccuguuuuucaugcaagggaaaggaauagggaaauugucaauggguuugauagccauugcgguggcuaguggcuugcucuggguagcagaaauucaaccccaguggauagcggccucaaucauacuagaguuuuuucucaugguacuguugauaccagaaccagaaaaacaaaggacuccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuugguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugaggacaacaugggcuuucugugaagucuugacuuuggccacaggaccaaucuuaaccuugugggaggguaacccgggaagguuuuggaacacgaccauagccguauccaccgccaacauuuucaggggaaguuacuuggcgggggcuggacuggcuuuuucacucauaaagaaugcacaaaccccuaggaggggaacugggaccacaggagagacacugggagagaaguggaagagacagcuaaacucauuagacagaaaagaguuugaagaguacaaaagaaguggaauacuagaaguggacaggacugaagccaagucagcccugaaagauggaucuaaaaccaagcaugcaguaucuagaggguccaguaagaucagauggauuguugagagagggaugguaaagccaaaagggaaaguuguagaucuuggcugugggagaggagguuggucuuauuacauggcaacacucaagaacgugacugaagugaaaggguauacaaaaggagguccaggacaugaagagccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucuguaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacggaaaaaccagacaugacaaucauugggagaaggcuucagcgauugcaagaagagcacaaagaaaccuggcauuaugaucaggaaaacccauacagaacuugggcguaucauggaagcuaugaagcuccuucgacaggcucugcauccuccauggugaacgggguagugaaacugcuaacaaaacccugggaugugauuccaauggugacucaguuagccaugacagauacaaccccuuuugggcaacaaagaguguucaaagagaagguggauaccagaacaccacaaccaaaacccggcacacgaaugauuaugaccacgacagccaauuggcugugggcucuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugauaaagaaagggcccuacaccaggaagggaaaugugaaucgugugucuacaacaugaugggaaaacgugagaaaaaguuaggagaguuuggcagagccaagggaagccgagcaaucugguacauguggcugggagcgcgguuucuggaguuugaagcccuggguuuuuugaaugaagaucacugguuuggcagagaaaauucauggaguggaguggaaggggaaggucugcacagauuggguuauauccuggaggagauagacaagaaggauggagaccuaauguaugcugaugacacagcaggcugggacacaagaaucacugaggaugaccuucaaaaugaagaacugaucacggaacagauggcuccccaccacaagauccuagccaaagcuauuuucaaacuaaccuaucaaaauaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaucacuuucacaagaucuuuaugaaagauggccgcucacuagucguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaauccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7808 - RNA, 9867 nt, Artificial Sequence
  derived and/or modified CDS sequence (wt) from DENV-4__FJ810417__SS-prME
ucaacgauaacauuacuaugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacuguuacguauaaauguccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggggagcccuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaaucugguccaaauugagaaccuugaguacacagugguuguaacaguccacaauggagacacccaugcaguaggaaaugacacauccaaucauggaguuacagcuacgauaacucccaggucaccaucgguggaagucaaauugccggacuauggagaacuaacacucgacugugaacccaggucuggaauugacuuuaaugagaugauucuaaugaaaaugaaaaagaaaacauggcucgugcauaagcaaugguuuuuggaucugccucuuccauggacagcaggagcagacacaucagagguucacuggaauuacaaagagagaaugguaacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggaaaaauugagaaucaagggaaugucauacacgauguguucaggaaaguucucaaucgacaaagagauggcagaaacacagcaugggacaacaguggugaaagucaaguaugaaggugcuggagcuccguguaaaguccccauagagauaagagauguaaacaaggaaaaagugguugggcgcgucaucucauccaucccuuuggcugagaacaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacaaacucaaggaauacuucaauggcuaugacgugcauagcuguuggagguaucacucuguuucugggcuucacaguucaagcggacauggguugugugguaucauggagugggagagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguccucugggaaggaggacacgaucucacuguaguggcuggggaugugaaggggguguugacuaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagccgcaauuaaagaucagaaagcugugcaugcugacauggguuauuggauagagagcucaaaaaaccagaccuggcagauagagaaagcaucucuuauugaggugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaauuagagauagacuucggagaaugcccuggaacaacagucacaauucaggaggauugugaccauagaggcccaucuuugaggaccaccacugcaucuggaaaacuagucacgcaguggugcugccgcuccugcacgaugccucccuuaagguucuugggagaagaugggugcugguauggaauggagauuaggccuuugaaugaaaaagaagagaacauggucaaaucacaggugacggccggacagggcacaucagaaacuuuuucuaugggacuguugugccugaccuuguuuguggaagaaugcuugaggagaagaguuacuaggaaacacaugauauuaguuguggugaucacucuuugugcuaucauccugggaggccucacauggauggacuuacuacgagcccucaucauguuaggggacacuaugucugguagaauaggaggacagauccaccuagccaucauggcaguguucaagaugucaccaggauacguacuggguguguuuuuaaggaaacucacuucaagagagacagcacuaaugguaauaggaauggccaugacaacgguacuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagccucuuaggaagcgcucuuuuaaaaaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacaguaucaggucucuacccccuggcaauuccagucacaaugaccuugugguacauguggcaagugaaaacacaaagaucaggagcccugugggacgucccuucacccgcugccacucaaaaagcugcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccgggaaaaaauccuaaacauguccaaacgaaaccuggccuuuucaagacccuaacuggagaaauuggagcaguaacauuggauuucaaacccggcacgucugguucucccaucaucaacaggaaaggaaaagucaucggacucuauggaaauggagugguuaccaaaucaggcgauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcuccaacgagagugguggcggccgagauggaagaggcccuccguggacugccaauccguuaucagacuccagcugugaaaucagaacacacaggaagagagauuguagaccucaugugucaugcaaccuucacaacaagacuuuugucaucaaccaggguuccgaacuacaaccuuauagugauggaugaagcacauuucaccgauccuucuaguguugcggcuaggggauacauuucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagugcugcucagagaagagggcgaauaggaaggaacccagcacaagaagacgaccaauacguuuucuccggagauccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugagcuacaagguagcuucugcuggcauuucuuauaaagaucgggaauggugcuucacaggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccuccagggccaagcucgcccuugacaacauagucaugcuccacacaacagaaagaggagggagggccuaucaacacgcccugaacgaacuuccggagucacuggaaacgcucaugcuuguagcuuuacuaggugcuaugacagcagguaucuuccuguuuuucaugcaagggaaaggaauagggaaauugucaauggguuugauagccauugcgguggcuaguggcuugcucuggguagcagaaauucaaccccaguggauagcggccucaaucauacuagaguuuuuucucaugguacuguugauaccagaaccagaaaaacaaaggacuccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauccugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuugguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugaggacaacaugggcuuucugugaagucuugacuuuggccacaggaccaaucuugaccuugugggaggguaacccgggaagguuuuggaacacgaccauagccguauccaccgccaacauuuucaggggaaguuacuuggcgggggcuggacuggcuuuuucacucauaaagaaugcacaaaccccuaggaggggaacugggaccacaggagagacacugggagagaaguggaagagacaacuaaacucauuagacagaaaagaguuugaagaguacaaaagaaguggaauacuagaaguggacaggacugaagccaagucagcccugaaagauggaucuaaaaccaagcaugcaguaucuagaggguccaguaagaucagauggauuguugagagagggaugguaaagccaaaagggaaaguuguagaucuuggcugugggagaggagguuggucuuauuacauggcgacacucaagaacgugacugaagugaaaggguauacaaaaggagguccaggacaugaagagccgauucccauggcuacuuauggcuggaauuuggucaaacuccauucagggguugacguguucuacaaacccacagaacaaguggacacccugcucugugauauuggggagucaucuucuaauccaacaauagaggaaggaagaacauuaagaguuuugaagaugguggagccauggcucucuucaaaaccugaauucuguaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacggaaaaaccagacaugacaaucauugggagaaggcuucagcgauugcaagaagagcacaaagaaaccuggcauuaugaucaggaaaacccauacagaacuugggcguaucauggaagcuaugaagcuccuucgacaggcucugcauccuccauggugaacgggguagugaaacuacuaacaaaacccugggaugugauuccaauggugacucaguuagccaugacagauacaaccccuuuugggcaacaaagaguguucaaagagaagguggauaccagaacaccacaaccaaaacccggcacacgaaugauuaugaccacgacagccaauuggcugugggcucuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacuggucgauaaagaaagggcccuacaccaggaagggaaaugugaaucgugugucuacaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauuggguuauauccuggaggagauagacaagaaggauggagaccuaauguaugcugaugacacagcaggcugggacacaagaauuacugaggaugaccuucaaaaugaagaacugaucacggaacagauggcuccccaccacaagauccuagccaaagcuauuuucaaacuaaccuaucaaaauaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaagauggccgcucacuagucguuccauguagaaaccaggaugaacugauagggagagccagaaucucgcagggggcuggauggagcuuaagagaaacagccugccucggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaauccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7809 - RNA, 9867 nt, Artificial Sequence
  derived and/or modified CDS sequence (wt) from DENV-4__FJ850057__SS-prME
ucaacgauaacauuacugugcuugauucccaccgcaauggcguuucacuugucaacaagagauggcgaaccccucaugauaguggcaaaacaugagagggggagaccucucuuguuuaagacaacagaggggaucaacaaaugcacucucauugccauggacuugggugaaaugugugaggacacuguuacguauaaauguccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaaccgucuucuuuguccuaaugaugcuggucgccccauccuauggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggggagcccuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaaucugguccaaauugagaaccuugaguacacagugguuguaacaguccacaauggagacacccaugcaguaggaaaugacacauccaaucauggaguuacagcuacgauaacucccaggucaccaucgguggaagucaaauugccggacuauggagaacuaacacucgacugugaacccaggucuggaauugacuuuaaugagaugauucuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagcuaugcauucugcccucgcuggagccacagaaguggacuccggugauggaaaucacauguuugcaggacaucucaagugcaaaguccguauggaaaaauugagaaucaagggaaugucauacacgauguguucaggaaaguucucaaucgacaaagagauggcagaaacacagcaugggacaacaguggugaaagucaaguaugaaggugcuggagcuccguguaaaguccccauagagauaagagauguaaacaaggaaaaagugguugggcgcgucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcuaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacaaacucaaggaauacuucaauggcuaugacgugcauagcuguuggagguaucacucuguuucugggcuucacaguucaagcggacauggguugugugguaucauggagugggagagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguccucugggaaggaggacacgaucucacuguaguggcuggggaugugaagggaguguugacuaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaggugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaauuagagauagacuucggagaaugccccggaacaacagucacaauucaggaggauugugaccauagaggcccaucuuugaggaccaccacugcaucuggaaaacuagucacgcaguggugcugccgcuccugcacgaugccucccuuaagguucuugggagaagaugggugcugguauggaauggagauuaggccuuugaaugaaaaagaagagaacauggucaaaucacaggugacggccggacagggcacaucagaaacuuuuucuaugggacuguugugccugaccuuguuuguggaagaaugcuugaggagaagaguuacuaggaaacacaugauauuaguuguggugaucacucuuugugcuaucauccugggaggccucacauggauggacuuacuacgagcccucaucauguuaggggacacuaugucugguagaauaggaggacagauccaccuagccaucauggcaguguucaagaugucaccaggauacguacuggguguguuuuuaaggaaacucacuucaagagagacagcacuaaugguaauaggaauggccaugacaacgguacuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagccucuuaggaagcgcucuuuuaaaaaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacaguaucaggucucuacccccuggcaauuccagucacaaugaccuugugguacauguggcaagugaaaacacaaagaucaggagcccugugggacguccccucacccgcugccacucaaaaagcugcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuggauuucaaacccggcacgucugguucucccaucaucaacaggaaaggaaaagucaucggacucuauggaaauggagugguuacuaaaucaggcgauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcuccaacgagagugguggcggccgagauggaagaggcccuacguggacugccaauccguuaucagacuccagcugugaaaucagaacacacaggaagagagauuguagaccucaugugucaugcaaccuucacaacaagacuuuugucaucaaccaggguuccgaauuacaaccuuauagugauggaugaagcacauuucaccgauccuucuaguguugcggcuaggggauacauuucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagugcugcucagagaagagggcgaauaggaaggaacccagcacaagaagacgaccaauacguuuucuccggagauccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugagcuacaagguagcuucugcuggcauuucuuauaaagaucgggaauggugcuucacaggggaaagaaauaaccaaauuuuagaagagaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccugacagagauugccaguuugccaacuuaccuuuccucuagggccaagcucgcccuugacaacauagucaugcuccacacaacagaaagaggagggagggccuaucaacacgcccugaacgaacuuccggagucacuggaaacgcucaugcuuguagcuuuacuaggugcuaugacagcagguaucuuccuguuuuucaugcaagggaaaggaauagggaaauugucaauggguuugauagccauugcgguggcuaguggcuugcucuggguagcagaaauucaaccccaguggauagcggccucaaucauacuagaguuuuuucuuaugguacuguugauaccagaaccagaaaaacaaaggacuccacaagacaaucaauugaucuacgucauauugaccauucucaccauuauuggucuaauagcagccaacgagauggggcugauugaaaaaacaaaaacggauuuuggguuuuaccaggugaaaacagaaaccaccauccucgauguggacuugagaccagcuucagcauggacgcucuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuugguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugaggacaacaugggcuuucugugaagucuugacuuuggccacaggaccaaccuugaccuugugggaggguaacccgggaagguuuuggaacacgaccauagccguauccaccgccaacauuuucaggggaaguuacuuggcgggggcuggacuggcuuuuucacucauaaagaaugcacaaaccccuaggaggggaacugggaccacaggagagacacugggagagaaguggaagagacagcuaaacucauuagacagaaaagaguuugaagaguacaaaagaaguggaauacuagaaguggacaggacugaagcuaagucagcccugaaagauggaucuaaaaccaagcaugcaguaucuagaggguccaguaagaucagauggauuguugagagagggaugguaaagccaaaagggaaaguuguagaucuuggcugugggagaggagguuggucuuauuacauggcgacacucaagaacgugacugaagugaaaggguauacaaaaggagguccaggacaugaagagccgauucccauggcuacuuauggcuggaauuuggucaaacuccauucagggguugacguguucuacaaacccacagaacaaguggacacccugcucugugauauuggggagucaucuucuaauccaacaauagaggaaggaagaacauuaagaguuuugaagaugguggagccauggcucucuucaaaaccugaauucuguaucaaaguccucaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacggaaaaaccagacaugacaaucauugggagaaggcuucagcgauugcaagaagagcacaaagaaaccuggcauuaugaucaggaaaacccauacagaacuugggcguaucauggaagcuaugaagcuccuucgacaggcucugcauccuccauggugaacgggguagugaaacugcuaacaaaacccugggaugugauuccaauggugacucaguuagccaugacagauacaaccccuuuugggcaacaaagaguguucaaagagaagguggauaccagaacaccacaaccaaaacccggcacacgaaugauuaugaccacgacagccaauuggcugugggcucuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugauaaagaaagggcccuacaccaggaagggaaaugugaaucgugugucuacaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggccugcacagauuggguuauauccuggaggagauagacaagaaggauggagaccuaauguaugcugaugacacagcaggcugggacacaagaaucacugaggaugaccuucaaaaugaagaacugaucacggaacagauggcuccccaccacaagauccuagccaaagcuauuuucaaacuaaccuaucaaaauaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaagauggccgcucacuagucguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaauccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggacuacaugccaguaaugaaaagauacagugcuccuucagagagugaaggaguucuguaa

SEQ ID NO: 7810 - RNA, 9867 nt, Artificial Sequence
  derived and/or modified CDS sequence (wt) from DENV-4__GQ199881__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaagaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguagugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaagauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacaucagaaacuuuuuuuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcaugauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaucgucugguucucccauuaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauuggccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacaggaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaucacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7811 - RNA, 9867 nt, Artificial Sequence
  derived and/or modified CDS sequence (wt) from DENV-4__GQ199882__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcguuacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaaaggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauugguaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacgguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuacccuuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugagguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggucagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggcuucaaucauacuggaguuuuuucucaugguacuguugauaccagaaccagaaaaacaaaggaccccacaagacaaucaauugaucuacgucauauuaaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucagcucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucucaccacuuucacaagaucuuuaugaaggauggccgcucacuaguuguuccauguagaaaccaggaugaacugauagggagagccagaaucucgcaaggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaauggaugaccacugaagacaugcucaaaguguggaacagaguguggauagaagacaaccccaauaugauugacaagaccccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7812 - RNA, 9867 nt, Artificial Sequence
  derived and/or modified CDS sequence (wt) from DENV-4__GQ199883__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucggcagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaauucaaggaacacuucaauggccaugacgugcauagcuguuggaggaaucacucuguuuuugggcuucacaguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaagauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcaaugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauaugcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauuggccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagcuguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacaggaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaucacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7813 - RNA, 9867 nt, Artificial Sequence
  derived and/or modified CDS sequence (wt) from DENV-4__GQ199884__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaauucaaggaacacuucaauggccaugacgugcauagcuguuggaggaaucacucuguuuuugggcuucacaguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaagauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaagucacagguggcggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacauauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccuuaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauaugcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcuuuggguagcagaaauucaaccccaguggauagcggccucaaucauacuggaguuuuuucucaugguacuguugauaccagaaccagaaaaacaaaggaccccacaagacaaucaauugaucuacgucauauuggccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagcuguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacaggaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaucacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7814 - RNA, 9867 nt, Artificial Sequence
  derived and/or modified CDS sequence (wt) from DENV-4__FJ882595__SS-prME
ucaacgauaacauuguugugcuugauucccaccgcaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucugcuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauauacgauguguucaggaaaguuuucaauugacaaagagauggcagaaacacagcaugggacaacaguggugaaagucaaguaugaaggcgcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauugguaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacgguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccauccuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacuucagaaacuuuuucuaugggucuguugugccugaccuuguuuguggaagaaugcuugaggagaagagucacuaggaaacacaugauauuagccgugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcucaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuacccuuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacacuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguucuucaugcaagggacaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacgauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaccccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggccacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguggaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcauagauugggauacauccuggaggagauagacaagaaagauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgucaaauggaagcugaaggagucaucacacaagaugacaugcagaacccaaaaggguugaaagaaagaguugagaaguggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucucaccacuuucacaagaucuuuaugaaggauggccgcucacuaguuguuccauguagaaaccaggaugaacugauagggagagccagaaucucgcagggggcuggauggaguuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7815 - RNA, 9867 nt, Artificial Sequence
  derived and/or modified CDS sequence (wt) from DENV-4__FJ882596__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacauguacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucugcuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggcgcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauugguaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacgguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugagggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacacaaaccgugggcccauggcacuuaggcaaacuagagauagacuuuggagaaugccccggaacaacagucacaauucaggaggauugugaccauagaggcccauccuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacuucagaaacuuuuucuaugggucuguugugccugaccuuguuuguggaagaaugcuugaggagaagagucacuaggaaacacaugauauuagccgugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcucaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuacccuuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacacuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuugaaaaggaggcugcgaacuuugauucuggcucccacgagagugguggcggccgagauggaagaggcccuacguggacugccaauucguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguucuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggccacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguggaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagcuauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgucaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucucaccacuuucacaagaucuuuaugaaggauggccgcucacuaguuguuccauguagaaaccaggaugaacugauagggagagccagaaucucgcagggggcuggauggaguuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7816 - RNA, 9867 nt, Artificial Sequence
  derived and/or modified CDS sequence (wt) from DENV-4__FJ850059__SS-prME
ucaacaauaacauuguugugcuugauucccacuguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuauuggucaauaccgaaccugaagacauugauugcuggugcaaccucacgucuaccugggucauguauggaacaugcacccagaguggagaacggagacgagagaagcgcucaguagcuuuaacaccacauucaggaaugggauuggaaacaagagcugagacauggaugucaucggaaggggcuuggaagcaugcucagagaguggagagcuggauacucagaaacccaggauuugcgcucuuggcaggauuuauggcuuacaugauugggcaaacaggaauccagcgaacugucuucuuuguccuaaugaugcuggucgccccauccuacggaaugcgaugcguaggaguaggaaacagagacuuuguggaaggagucucagguggaguaugggucgaccugguguuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacaucuaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggauuugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguuuaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugaccugcauagcuguuggaggaaucacucuguuuuugggcuuuacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaauugcccacaaagauggggucuguggaauuagaucaaccacgaggcuggaaaauguuauguggaagcaaauaaccaaugagcuuaacuauguucucugggaaggaggacaugaucucacuguaguggcuggggaugcgaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuugguauguuuacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaacccuagcucuuuccuugacuuucauaagaucaacaaugucauuggucauggcuuggaggaccauuauggcuguguuguuuguggucacacucauucccuugugcaggacaagcugucuucagaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagagggcuauucgggaaaacucagguuggaguagggauacacauggaagguguauuucacacaauguggcauguuacaagaggaucagugaucugccacgagacugggagauuggagccaucuugggcugacgucaggaaugacaugauaucauacgguggaggauggaggcuuggagacaaaugggacaaagaagaagacguucagguccucgcuauagaaccaggaaaaaaucccaaacauguccaaacgaaaccuggccuuuucaagaccuuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauacuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgacuaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugacacagaauauccaaaaacgaaacucacggacugggacuuuguggucacuacagauauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacuggggaaagaaauaaccaaauuuuggaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaccaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccaucauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcucagaaaaggacagcugcuggaaucaugaaaaauccaacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuuaaccuugugggagggcaacccgggaagguuuuggaacacgaccauagccguauccaccgccaacauuuucaggggaaguuacuuggcgggagcuggauuggcuuuuucacucauaaagaaugcacaaaccccuaggagggggacugggaccacaggagagacacugggagagaaguggaagagacagcuaaacucauuagacaggaaagaguuugaagaguauaaaagaaguggaauacuagaaguggacaggacugaagccaagucugcccugaaagacgggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacagacccacagagcaaguggacacccugcucugugauauuggggagucaucuucuaauccaacaauagaggaaggaagaacauuaagaguucugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacucuacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaggagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaauuaggagaguuuggaagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaagggcugaaagaaagaguugagaaauggcugagagaguguggugucgacagguuaaagaggauggcaaucaguggagacgacugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacgacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauugggcuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7817 - RNA, 9867 nt, Artificial Sequence
  derived and/or modified CDS sequence (wt) from DENV-4__FJ882598__SS-prME
ucaacgauaacauuguugugcuugauucccaccgcaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacuguuacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuacaugauugggcagacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuuuuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaccugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaauauagaauuagaaccccccuuuggggacagcuacauagugauagguguuggaaacagcgcauuaacacuccauugguucaggaaagggaguuccauugguaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacgguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuuuaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacaucagaaacuuuuucuaugggucuguugugccugaccuuguuuguggaagaaugccugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggguacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagagauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugagguggaugaggauauuuuucgaaagaaaagauuaacuauaauggacuuacaccccggagcuggaaagacaaagagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaacuuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguagaaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccauuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuauuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggcuucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaaacaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaagguuugaaagaaagaguugagaaauggcugagagaguguggugucgacagauuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucucaccacuuucacaagaucuuuaugaaggauggccgcucauuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaauggaugaccacugaagacaugcucaaaguguggaacagaguguggauagaagacaaccccaauaugauugacaagaccccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7818 - RNA, 9867 nt, Artificial Sequence
  derived and/or modified CDS sequence (wt) from DENV-4__FJ882601__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcggugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagcuaaggaaguggcucuguuaagaaccuauugcauugaagccucaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacguucaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauugugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcuguacaccagguuuuuggaagcguguauacaaccauguuuggaggagucucauggaugauuagaauccuaauuggguucuuaguguuguggauuggcacgaauucaaggaacacuucaauggccaugacgugcauagcuguuggaggaauuacucuguuuuugggcuucacaguucaagcggacauggguuguguggugucauggagugggagagaguugaaguguggaagcggaaucuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacaguacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugccauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuagguaaacuagagauagacuuuggagaaugccccggaacaacagucacaauucaggaagauugugaccauagaggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaaaucacagguggcggccggacagggcacaucagaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacucucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaauaauagaagugaagcaagaugaggauggcucuuucuccauacgggacgucgaggaaaccaauaugauaacccuuuuggugaagcuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacauauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucuccuauugucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaagaaggcugcgaacuuugauucuggcucccacgagagugguggcggccgagauggaagaggcccuacguggacugccaauccguuaccagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuggaugcacguguauacgcugaccccauggcuuugaaggauuucaaggaguuugccaguggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuuuaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauuggccauucucaccauuauuggucuaauagcagccaacgagauggggcugauagaaaaaacaaaaacggauuuuggguuuuaccaggaaaaaacagaaaccaccauccucgauguggacuugagaccagcuucagcauggacgcucuaugcgguagccaccacaauuuuaacucccaugcugagacacacuauagaaaacacgucggccaaccuaucucuaacagccauugccaaccaggcagccguccuaaugggacuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccugaaaaggacagcugcuggaaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagcuguauccaccgccaacauuuucaggggaaguuacuuggcgggagcuggacuggcuuuuucacucauaaagaauguacaaaccccuaggaggggaacugggaccacaggagagacacugggagagaaguggaagagacagcuaaacucauuagacaggaaagaguuugaagaguauaaaagaaguggaauacuagaaguggacaggacugaagccaaguccgcccugaaagaugggucuaaaaucaagcaugcaguaucuagaggguccaguaagaucagauggauuguugagagagggaugguaaagccaaaggggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccucaaccccuacaugccaacagucauagaagagcuggagaaacugcagagaaaacacggugggaaccuugucagaugcccgcuguccaggaacuccacccaugagauguauugggugucaggagcgucgggaaauauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacgccgcaaccaaaaccaggcacacgaaugguuaugaccacgacagccaauuggcuaugggcccuccuuggaaagaagaaaaaucccagacuguguacaagggaagaguucaucucaaaaguuagaucaaacgcagccauaggcgcagucuuucaggaagaacaaggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcagguugggacacaagaaucacugaggaugaccuucaaaaugaggaacuggucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaucacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaacuugaucggaaaagaggaauacguggauuacaugccaguaaugaaaagauacagugcuccuucagagagugaaggaguucuguaa

SEQ ID NO: 7819 - RNA, 9867 nt, Artificial Sequence
  derived and/or modified CDS sequence (wt) from DENV-4__FJ226067__SS-prME
ucaacgauaacauugcugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuagucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggggagcccuaucugaaagaggaacaggaccaacaguacauuugccggagagaugugguagacagaggguggggcaaugguuguggcuuguuuggaaaaggaggaguugugacaugugcgaaguuuucauguucggggaagauaacaggcaaucugguccaaauugagaaccuugaguauacagugguuguaacaguccacaauggagacacccaugcaguaggaaaugacacauccaaucauggaguuacagccacgauaacucccaggucaccaucgguggaagucaaauugccggacuauggagaacuaacacucgauugugaacccaggucuggaauugacuuuaaugagaugauucuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggaaaaauugagaaucaagggaaugucauacacgaugugcucaggaaaguucucaaucgacaaagagauggcagaaacacagcaugggacaacaguggugaaagucaaguaugaaggugcuggagcuccguguaaaguccccauagagauaagagauguaaacaaggaaaaagugguugggcgcgucaucucauccaccccuuuggcugagaauaccaacaguguaaccaacauagaauuagaaccccccuuuggggacagcuacauagugauagguguuggaaacagcgcauuaacacuccauugguucaggagagggaguuccauuggcaagauguuugaguccacauacagaggugcaaaacgaauggccauucuaggugaaacagcuugggauuuugguuccguugguggacuguucacaucauugggaaaggcugugcaccagguuuuuggaagcguguauacaaccauguuuggaggagucucauggaugauuagaauccuaauuggguucuuaguguuguggauuggcacaaacucaaggaacacuucaauggcuaugacgugcauaacuguuggagguaucacucuguuucugggcuucacaguucaagcggacauggguugugugguaucauggagugggagagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuaugcccucugggaaggaggacacgaucucacuguaguggcuggggaugugaaggggguguugaccaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaucagaccuggcagauagagaaagcaucucuuauugaagugaaaacaugucuguggcccaagacccacacacuguggagcaauggaguacuggaaagccagaugcucauuccaaaaucauaugcgggcccuuuuucacagcacaauuaccgccagggcuaugccacgcaaaccguggguccauggcacuuaggcaaauuagagauagacuucggagaaugccccggaacaacagucacaauucaggaggauugugaccauagaggcccaucuuugaggaccaccacugcaucuggaaaacuagucacgcaguggugcugccgcuccugcacgaugccucccuuaagguucuugggagaagaugggugcugguauggaauggagauuaggcccuugagugaaaaagaagagaacauggucaaaucacaggugacggccggacagggcacaucagaaacuuuuucuaugggacuguugugccugacuuuguuuguggaagaaugcuugaggagaagagucacuaggaaacacaugauauuaguugugguaaucacucuuugugcuaucauccugggaggccucacauggauggacuuacuacgagcccucaucauguuaggggacacuaugucugguagaauaggaggacagauccaccuagccaucauggcaguguucaagaugucaccaggauacgugcuggguguguuuuuaaggaaacucacuucaagagagacagcacuaauggugauaggaauggccaugacaacgguacuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuccaaaaacagucucauuggguagaaauaacagcacucauccuaggagcccaagcucugccaguguaccuaaugacucuuaugaaaggagccucaagaagaucuuggccucucaacgagggcauaauggcuguggguuugguuagucucuuaggaagcgcccuuuuaaaaaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguucucgccauagaaccaggaaaaaauccuaaacauguccaaacgaaaccuggccuuuucaagacccuaacuggagaaauuggagcaguaacauuggauuucaaacccggaacgucugguucucccaucaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaucagaccccagcugugaaaucagaacacacaggaagagagauuguagaccucaugugucaugcaaccuucacaacaagacuuuugucaucaaccaggguuccgaauuacaaccuuauagugauggaugaagcacauuucaccgauccuucuaguguugcggcuaggggauacauuucgaccaggguggaaaugggagaggcagcagccaucuucaugacugcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggauuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagugcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuacaagguagcuucugcuggcauaucuuauaaagaucgggaguggugcuucacaggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccuccagggccaagcucgcccuugauaacauagucaugcuccacacaacagaaagaggagggagggccuaucaacacgcccugaacgaacuuccagagucacuggaaacacucaugcuuguagcuuuacuaggugcuaugacagcagguaucuuccuauuuuucaugcaagggaaaggaauagggaaauugucaauggguuugauagccauugcgguggcuagugguuugcucuggguagcagaaauucaaccccaguggauagcggccucaaucauacuagaguuuuuucucaugguacuguugauaccagaaccagaaaaacaaaggacuccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcugcuagcaaugggaugcuauucccaagugaacccaacaaccuugacagcauccuuagucaugcuuuuaguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggaggguaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguacaaaagaaguggaauacuagaaguggacaggacugaagccaagucagcccugaaagaugggucuaaaaucaagcaugcaguaucuagaggguccagcaagaucagauggauuguugagagagggaugguaaagccaaaagggaaaguuguagaucuuggcugugggagaggaggauggucuuauuacauggcgacacucaagaacgugacugaagugaaaggguauacaaaaggagguccgggacaugaagagccaauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagagucuugaagaugguggagccauggcucucuucaaaaccugaauucuguaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacggaaaaaccagacaugacaaucauugggagaaggcuucagcgauugcaagaagagcacaaagaaaccuggcauuaugaucaggagaacccauacagaaccugggcguaucauggaagcuaugaagcuccuucgacaggcucugcauccuccauggugaacgggguagugaaacugcuaacaaaacccugggaugugauuccaauggugacucaguuagccaugacagauacaaccccuuuugggcaacaaagaguguucaaagagaagguggauaccagaacaccacaaccaaaacccggcacacgaaugguuaugaccacgacagccaauuggcugugggcucuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugauaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauuggguuauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaauaaaguggugaaaguccucagacccacaccgagaggagcggugauggauaucauauccaggaaagaccaaagaggcaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuagucguuccauguagaaaccaggaugagcuaauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagaccccaguccauucgugggaagauauaccuuaccuagggaaaagagaggauuugugguguggauccuugauuggacuuucuucuagagccaccugggcgaagaacauucacacggccauaacccaggucaggaaccugaucggaaaagaggaauacguagauuacaugccaguaaugaaaagauacagugcucuuucagagagugaaggaguucuguaa

SEQ ID NO: 7820 - RNA, 9867 nt, Artificial Sequence
  derived and/or modified CDS sequence (wt) from DENV-4__EU854299__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagauuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucauggaguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguucuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucgggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcucacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucucauugaaguaaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagacaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggagugguuaccaaaucaggugacuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugacagcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcccagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaaggaaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaaugggcuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacaacuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccagggcaugaagaaccgauucccauggcuacuuauggcuggaauuuggucaaacuccauucagggguugacguguucuacaaacccacagagcagguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaauggucaugacuacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagccgugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaagauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7821 - RNA, 9867 nt, Artificial Sequence
  derived and/or modified CDS sequence (wt) from DENV-4__FJ182016__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacguccaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaaggucccucaugccaagagacaggaugugacagugcugggaucucaggaaggagccaugcauucugcccucgcuggagccacagaaguggacuccggugauggaaaucacauguuugcaggacaucuuaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacaaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagccgugguaaucacucuuugugcuaucauccuggggggccucacauggauggacuugcuacgagcccucaucauguugggggacacuaugucugguagaauaggaggacagacccaccuagccaucauggcaguguucaagaugucaccgggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugccuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuugggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguaggaauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacacaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacaucucgaccaggguggaaaugggagaggcagcagccaucuucaugaccgcaaccccucccggagcgacagauccuuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggauguuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaaguuuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugagaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggggaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaggaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7822 - RNA, 9867 nt, Artificial Sequence
  derived and/or modified CDS sequence (wt) from DENV-4__EU854300__SS-prME
ucaacgauuacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagccuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuacaugauugggcaaacagggauccagcgaacugucuucuuuguccuaaugaugcuggucgccccauccuacggaaugcgaugcguaggagugggaaacagagacuuuguggaaggagucucagguggagcaugggucgaccuggugcuagaacauggaggaugcguuacaaccauggcccagggaaaaccaaccuuggauuuugaacuaaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacagugugaccaacauagaauuagaaccccccuuuggggacaguuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcuguacaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggaaugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaaaacaugggggaaagcaaaaaucuucaccccugaaacaagaaacagcacauuuuuaauagauggaccagacaccucugaaugccccaaugaacgaagagcguggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacacaaugguguugccgcuccugcacgaugccccccuuaagguucuuaggagaagaugggugcugguaugggauggagauuaggcccuugagugaaaaagaagagaacaugguuaaaucacaggugacggcuggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguggggauacacauagaagguguauuucacacaauguggcauguuacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaaggauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaagcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaaccuagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaaaguagcuucugcuggcauuucuuacaaagaucgggaauggugcuucacuggggagagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugauaacauaguuaugcuucacacaacagaaagaggagggagggccuaucaacacgcccugaacgaacuuccggagucacuggaaacacucaugcuuguagccuuacuaggugcuaugacagcagguaucuuccuguuuuucaugcaagggaaagggauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcggccaacgagauggggcugauagaaaaaacaaaagcggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuucacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaagaacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcagugucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccuuggcucucuucaaaaccugaauucugcaucaaaguccuuaaccccuacaugccaacagucauagaagagcuggaaaaacugcagagaaaacauggugggaaccuugucagaugcccgcuguccaggaacuccacccaugagauguauugggugucaggagcgucgggaaacaucgugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaauccauacagaaccugggcguaucauggaagcuaugaagcuccuucgacaggcucugcguccuccauggugaacgggguggugaaacugcuaacaaaacccugggauguaauuccaauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacuagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcauagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuuuaaacuaaccuaucaaaacaaaguggugaaaguccucagacccacaccgagaggagcggugauggauaucauauccaggaaagaccagagagguaguggacaaguugggacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaaugacaugggaaaggugaggaaagauauuccgcagugggaaccaucuaagggauggaaaaacuggcaagaaguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucuacgucuagccuccauggccauaugcucagcaguuccaacggaaugguuuccaacaaguagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7823 - RNA, 9867 nt, Artificial Sequence
  derived and/or modified CDS sequence (wt) from DENV-4__FJ182017__SS-prME
ucaacgauaacauuguugugcuugauucccaccgugauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucugccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuggaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagacggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugccuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucuccuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucaugggcugacgucaggaaugauaugauaucauacggugggggauggaggcuuggagauaaaugggacaaagaagaagacguucagguccucgcuauagaaccaggaaaaaaucccaaacauguccaaacgaaaccuggccuuuucaagacccugacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaaggauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuuacucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuacucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgccuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaaaaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaacccuuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgauagguuaaagaggauggcaauuaguggagaugauugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuagguaaagcuuacgcccagauguggucgcuuauguacuuccacagaagggaucugcgucuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7824 - RNA, 9867 nt, Artificial Sequence
  derived and/or modified CDS sequence (wt) from DENV-4__EU854301__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauuguauugaagccucaauaucaaacauaacuacggcaacaagauguccaacgcagggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaauaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagauuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagauuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagaguuaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacucucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuucuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaagcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguuccuagcauaaaggcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcgagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggagcaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgcuaguuugccaacuuaccucuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauggggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuauucuugaugagaacaacaugggcuuucugugaagucuugacuuuggccacaggaccaaucuugaccuugugggagggcaacccgggaagguuuuggaacacgacuauagccguaucuaccgccaauauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcagugucuagaggguccaguaagaucagauggauuguugagagaggaaugguaaagccaaaagggaaaguuguagaucuuggcugugggagaggaggauggucuuauuacauggcgacacucaagaacgugacugaagugaaaggguauacaaaaggagguccaggacacgaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaucuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagagaaaccagacaugacaaucauugggaggaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacuguuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagaggucccuuuuugcucccaccacuuucacaagaucuuuaugaaggauggccgcucacuaguuguuccaugcagaaaccaggaugaacugauagggagagccagaaucucgcagggggcuggauggagcuuaagggaaacagccugccuaggcaaagcuuacgcccagauguggucgcuuauguacuuccacagaagggaucugcgcuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauagacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccagcaaugaaaagauacagugcuccuucagagagugaaggaguucuguaa

SEQ ID NO: 7825 - RNA, 9867 nt, Artificial Sequence
  derived and/or modified CDS sequence (wt) from DENV-4__FJ639736__SS-prME
ucaacgaugacauuguugugcuugauucccaccgcaauggcguuucacuugucaacaagagauggcgaaccccucaugauaguggcaaaacaugaaagagggagaccucucuuguuuaagacaacagaggggaucaacaaaugcacucucauugccauggacuugggugaaaugugugaggauacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcuccuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaccaacaguacaucugccggagggaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccgucgguagaagucaaauugccggacuauggagaacuaacacuagauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauucaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaucagguuuuuggaaguguguauacaaccauguuuggaggagucucauggaugauuagaauccuaauuggguucuuaguguuguggauugguacgaacucaaggaacacuucaauggccaugacaugcauagcuguuggaggaaucacucuguuuuugggcuucacaguucaagcggacauggguuguguggugucauggagugggagagaauugaaguguggaagcggaauuuuuguaguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccguuccugcacaaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccuaaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauaugugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcgauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaaccgugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauugaugaggagaggagaccuuccaguguggcugagcuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauauuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacuccuaugcugagacacaccauagaaaacacgucggccaaccuaucucuggcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagggaggcccagaaaaggacagcugcuggaauuaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccucgucagaugcccgcuguccaggaacuccacccaugagauguauugggugucaggagcgucgggaaacauugugagcucugugaacacaacaucaaagauguuguugaacagguucacaacaaggcauaggaaacccaccuaugagaaggacguagaucuuggggcaggaacgagaagugucucuacugaaacagaaaaaccagacaugacaaucauugggagaaggcuucagcgauugcaagaagagcacaaagaaacauggcauuaugaucaggagaauccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcuguuaaugacagucgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuagaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaagguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaauccaaaaggguugaaagaaagaguugagaaauggcugagagaguguggugucgacagguuaaaaaggauggcaaucaguggagacgauugcguggugaagccccuagaugagagguuuggcacuucccuccucuuccugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7826 - RNA, 9867 nt, Artificial Sequence
  derived and/or modified CDS sequence (wt) from DENV-4__FJ639737__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacuguuacguauaaaugcccccuacugaucaauaccgaaccugaagacauugauugcuggugcaaccucacgucuaccugggucauguaugggacauguacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuucguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaucaacaguacaucugccggagagaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaauugccggacuauggagaacuaacacucgacugugaacccaggucuggaauugacuuuaaugagaugauccuaaugaaaaugaaaaagaaaacauggcucgugcacaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcacgggacaacaguggugaaagucaaguaugaaggugcuggagcuccguguaaaguccccauagagauaagagauguaaacaaggaaaaagugguugggcgcguuaucucauccaccccuuuggcugagaauaccaacagugugaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauacuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaagguaagagagcacucacacccccagugagugaucugaaauauucauggaagacauggggaaaagcaaaaaucuucaccccugaagcaagaaauagcacauuuuuaauagacggaccagacaccucugaaugccccaaugaacgaagagcauggaauucucuugagguggaagacuauggauuuggcauguucacuaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugccuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcgucuggaaaacuagucacgcaaugguguugccgcuccugcacgaugccccccuuaagguucuugggagaagaugggugcugguaugggauggagauuaggcccuugagugaaaaagaagagaacauggucaaaucacaggugacggccggacagggcacaucggaaacuuuuucuaugggucuguugugccugaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacgacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucacuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguuaugaguggcagcucagcagaucugucacuagagaaggccgcuagugugcaaugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauagaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguccagguccucgcuauagaaccaggaaaaaaucccaaacauguccaaacgaaacccggccuuuucaagacccuaacuggagaaauuggagcaguaacauuagauuucaaacccggaacgucugguucucccauuaucaacaggaaaggaaaagucaucggacuuuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagggcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagaccuuuguagaauuaaugaggagaggagaccuuccgguguggcugagcuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccacugccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacagaacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccagggcaugaagaaccgauucccauggcuacuuauggcuggaauuuggucaaacuccauucagggguugacguguucuacaaacccauagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccaccuaugagaaggacguagaucuuggggcaggaacgagaagugucucuacugaaacagaaaaaccagacaugacaaucauugggagaaggcuccagcgauugcaagaagagcacaaagaaacauggcauuaugaccaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcugugaaugacagccgguucugggaacugguugacaaagaaagggcccuucaccaagaagggaaaugugaaucgugugucuacaacaugaugggaaaacgugagaaaaaguuaggagaguuuggcagagccaagggaagccgagcaaucugguacauguggcugggagcgcgauuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuaggaaaaagagaggauuuguggugcggaucccugauuggacuuucuucuagagccaccugggcgaaaaacauucacacggccauaacucaggucaggaaccugaucggaaaagaggaauacguggauuacaugccaguaaugaaaagauacagugcuccuucagagagugaaggaguucuguaa

SEQ ID NO: 7827 - RNA, 9867 nt, Artificial Sequence
  derived and/or modified CDS sequence (wt) from DENV-4__FJ639738__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugaaaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaaccuaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccgugcaaaguccccauagagauaagagauguaaacaaggaaaaagugguugggcgcguuaucucauccaccccucuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaaucggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcguccgcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccggugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagacuuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugccugaggagaagagucacuaggaaacacaugauauuagcugugguaaucacucuuugugcuaucauccuggggggccucacauggauggacuugcuacgagcccuaaucauguugggggacacuaugucugguagaauaggaggacagacccaccuagccaucauggcaguguucaagaugucaccaggauacgugcuggguguguuuuuaaggagacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuguagaaccaggaaaaaaucccaaacauguccaaacgaaaccuggccuuuucaagaccauaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagauugacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagaguaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagauauaucugaaaugggggcuaauuuuagagcugggagagugauagacccuagaagaugccucaagccaguuauccuaacagaugggccagagagaguuauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuggaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaauuaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagaggcaugguaaagccaaaagggaaaguuguagaucuuggcugugggagaggaggauggucuuauuacauggcgacacucaagaacgugacugaagugaaaggguauacaaaaggaggcccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguuuacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccuaggcaaagcuuacgcccagauguggucgcuuauguacuuccacagaagggaucugcguuuagccucuauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7828 - RNA, 9867 nt, Artificial Sequence
  derived and/or modified CDS sequence (wt) from DENV-4__FJ639739__SS-prME
ucaacgaugacauuguugugcuugauucccaccgcaauggcguuucacuugucaacaagagauggcgaaccccucaugauaguggcaaaacaugaaagagggagaccucucuuguuuaagacaacagaggggaucaacaaaugcacucucauugccauggacuugggugaaaugugugaggauacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcuccuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaccaacaguacaucugccggagggaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccgucgguagaagucaaauugccggacuauggagaacuaacacuagauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauucaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaucagguuuuuggaaguguguauacaaccauguuuggaggagucucauggaugauuagaauccuaauuggguucuuaguguuguggauugguacgaacucaaggaacacuucaauggccaugacaugcauagcuguuggaggaaucacucuguuuuugggcuucacaguccaagcggacauggguuguguggugucauggagugggagagaauugaaguguggaagcggaauuuuuguaguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcagauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccguuccugcacaaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccuaaccuuguuuguggaagaaugcuugaggagaagagucacuaggaaacacaugauauuagcugugguaaucacucuuugugcuaucauccugggaggccucacauggauggacuugcuacgagcccucaucauguugggggauacuaugucugguagaauaggaggacagacccaccuagccaucauggcaguguucaagaugucaccaggauaugugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcgauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuagcuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaaccgugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauugaugaggagaggagaccuuccaguguggcugagcuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauauuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacuccuaugcugagacacaccauagaaaacacgucggccaaccuaucucuggcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagggaggcccagaaaaggacagcugcuggaauuaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaauuguagaucuuggcuguggaagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcauuaaaguccuuaaccccuacaugccaacagucauagaagagcuggagaaacugcagagaaaacauggugggaaccucgucagaugcccgcuguccaggaacuccacccaugagauguauugggugucaggagcgucgggaaacauugugagcucugugaacacaacaucaaagauguuguugaacagguucacaacaaggcauaggaaacccaccuaugagaaggacguagaucuuggggcaggaacgagaagugucucuacugaaacagaaaaaccagacaugacaaucauugggagaaggcuucagcgauugcaagaagagcacaaagaaacauggcauuaugaucaggagaauccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcuguuaaugacagucgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuagaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaagguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaauccaaaaggguugaaagaaagaguugagaaauggcugagagaguguggugucgacagguuaaaaaggauggcaaucaguggagacgauugcguggugaagccccuagaugagagguuuggcacuucccuccucuuccugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaauggcuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7829 - RNA, 9867 nt, Artificial Sequence
  derived and/or modified CDS sequence (wt) from DENV-4__JN819409__SS-prME
ucaacgauaacauugcugugcuugauucccaccguaauggcguuucacuugucaacaagagauggugaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacggcuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacuuagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaccaacaguacaucugccggagagaugugguagauagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuuuaaugagaugauccuaaugaaaaugaaaaagaaaacauggcucgugcauaagcaaugguuuuuggaucuaccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaaguguaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccacuccuuuggcugagaauaccaacgguguaaccaacauagaauuagaaccccccuuuggggacagcuacauagugauagguguuggaaacagcgcauuaacacuccauugguuuaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauugguacgaacucgaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgacuaacauauggaugaaauuccgggagggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggcccuugagugaaaaagaagagaacaugguuaaaucacaggugacagccggacagggcacaucggaaacuuuuucuaugggucuguugugccugaccuuguuuguggaagaaugcuugaggagaagagucacuaggaaacacaugauauuagcugugauaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaaccggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaaucggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcuccuacgagagugguggcagccgagauggaagaggcccuacgcggacugccaauccguuaucagaccccagcugugaaaucagaacacacaggaagagagauuguagaccucaugugccaugcaaccuucacaacaagacuuuugucaucaaccaggguuccaaauuacaaccuuauaguaauggaugaagcacauuucaccgauccuuccagugucgcggcuagaggauacauuucgacuaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggccaauuuuagagcugggagagugauagauccuagaagaugccucaagccaguuauccuaacagaugggccagagagaguuauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaacaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauaucuuauaaagaucgggaauggugcuucacaggggaaagaaauaaccaaauuuuagaagaaaacauggagguugaaauuuggacuagagagggagaaaagaaaaaacugaggccaagaugguuagaugcucguguauacgcugaccccauggcuuugaaggauuucaaggaguuugccaguggaaggaagaguauaacucuugacauccuaacagagauugccaguuugccaacuuaccuuuccucuagggccaagcucgcccuugacaacauagucaugcuccacacaacagaaagaggagggagggccuaucaacacgcucugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccaucgccaaccaggcagccguccuaauggggcuuggaaaaggauggccacuccauagaauggaccucggugugccgcuguuagcaaugggaugcuauucccaagugaauccaacaaccuugacagcauccuuagucaugcuuuuaguccacuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaauauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguugacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucaacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaaaggaagaguucaucucaaaaguuagaucaaacgcagccauaggcgcagucuuucaggaggaacagggauggacaucagccagugaagcugugaaugacagccgguuuugggaacugguugacaaagaaagggcccuucaccaagaaggaaaaugugaaucgugugucuauaacaugaugggaaaacgugagaaaaaguuaggagaguuugguagagccaagggaagccgagcaaucugguacauguggcugggagcgcgguuuuuggaauuugaagcccuggguuuuuugaaugaagaccacugguuuggcagagaaaauucauggaguggaguggaaggggaaggccugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguagugaaaguccucagacccacaccgagaggagcggugauggacaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaaucccaauaugacugacaagacuccaauccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggacuacaugccaguaaugaaaagauacagugcuccuucagagagugaaggaguucuguaa

SEQ ID NO: 7830 - RNA, 9867 nt, Artificial Sequence
  derived and/or modified CDS sequence (wt) from DENV-4__FJ639742__SS-prME
ucaacgaugacauuguugugcuugauucccaccgcaauggcguuucacuugucaacaagagauggcgaaccccucaugauaguggcaaaacaugaaagagggagaccucucuuguuuaagacaacagaagggaucaacaaaugcacucucauugccauggacuugggugaaaugugugaggauacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcuccuggcaggauuuauggcuuauaugguugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaccaacaguacaucugccggagggaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccgucgguagaagucaaauugccggacuauggagaacuaacacuagauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauucaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaucagguuuuuggaaguguguacacaaccauguuuggaggagucucauggaugauuagaauccuaauuggguucuuaguguuguggauugguacgaacucaaggaacacuucaauggccaugacaugcauagcuguuggaggaaucacucuguuuuugggcuucacaguucaagcggacauggguuguguggugucauggagugggagagaauugaaguguggaagcggaauuuuuguaguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauacucauggaagacauggggaaaagcaaaaaucuucaccccugaagcaagaaacagcacauuuuuaauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccguuccugcacaaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccuaaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauaugugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucugcaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuagugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcgauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaaccgugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauugaugaggagaggagaccuuccaguguggcugagcuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauauuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacuccuaugcugagacacaccauagaaaacacgucggccaaccuaucucuggcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagggaggcccagaaaaggacagcugcuggaauuaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcauuaaaguccuuaaccccuacaugccaacagucauagaagagcuggagaaacugcagagaaaacauggugggaaccucgucagaugcccgcuguccaggaacuccacccaugagauguauugggugucaggagcgucgggaaacauugugagcucugugaacacaacaucaaagauguuguugaacagguucacaacaaggcauaggaaacccaccuaugagaaggacguagaucuuggggcaggaacgagaagugucucuacugaaacagaaaaaccagacaugacaaucauugggagaaggcuucagcgauugcaagaagagcacaaagaaacauggcauuaugaucaggagaauccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcuguuaaugacagucgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuagaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaagguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaauccaaaaggguugaaagaaagaguugagaaauggcugagagaguguggugucgacagguuaaaaaggauggcaaucaguggagacgauugcguggugaagccccuagaugagagguuuggcacuucccuccucuuccugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7831 - RNA, 9867 nt, Artificial Sequence
  derived and/or modified CDS sequence (wt) from DENV-4__FJ639745__SS-prME
ucaacgaugacauuguugugcuugauucccaccgcaauggcguuucacuugucaacaagagauggcgaaccccucaugauaguggcaaaacaugaaagagggagaccucucuuguuuaagacaacagaggggaucaacaaaugcacucucauugccauggacuugggugaaaugugugaggauacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcgcuccuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaagaacaggaccaacaguacaucugccggagggaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccgucgguagaagucaaauugccggacuauggagaacuaacacuagauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauucaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaucagguuuuuggaaguguguauacaaccauguuuggaggagucucauggaugauuagaauccuaauugggcucuuaguguuguggauugguacgaacucaaggaacacuucaauggccaugacaugcauagcuguuggaggaaucacucuguuuuugggcuucacaguucaagcggacauggguuguguggugucauggagugggagagaauugaaguguggaagcggaauuuuuguaguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuugauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccguuccugcacaaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccuaaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauaugugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcgauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagauccauuuccccagagcaacagcccaauagaagacaucgagagagagauuccggaaaggucauggaacacaggguucgacuggauaacagacuaccaagggaaaaccgugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauugaugaggagaggagaccuuccaguguggcugagcuauaagguagcuucugcuggcauuucuuacaaagaucgggaauggugcuucacuggggaaagaaacaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauauuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggacuuuggguuuuaccagguaaaaacagaaaccaccauccucgauguggacuugagaccagcuucagcauggacgcucuaugcgguagccaccacaauucugacuccuaugcugagacacaccauagaaaacacgucggccaaccuaucucuggcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaagcaaaagccacaagggaggcccagaaaaggacagcugcuggaauuaugaaaaauccuacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggaaggcaacccgggaagguuuuggaacacgaccauagccguauccaccgccaacauuuucaggggaaguuacuuggcgggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcauuaaaguccuuaaccccuacaugccaacagucauagaagagcuggagaaacugcagagaaaacauggugggaaccucgucagaugcccgcuguccaggaacuccacccaugagauguauugggugucaggagcgucgggaaacauugugagcucugugaacacaacaucaaagauguuguugaacagguucacaacaaggcauaggaaacccaccuaugagaaggacguagaucuuggggcaggaacgagaagugucucuacugaaacagaaaaaccagacaugacaaucauugggagaaggcuucagcgauugcaagaagagcacaaagaaacauggcauuaugaucaggagaauccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcuguuaaugacagucgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuagaauuugaagcccuggguuuuuugaaugaagaucacugguuuggcagagaaaauucauggaguggaguggaaggggaaggccugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaagguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaauccaaaaggguugaaagaaagaguugagaaauggcugagagaguguggugucgacagguuaaaaaggauggcaaucaguggagacgauugcguggugaagccccuagaugagagguuugccacuucccuccucuuccugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7832 - RNA, 9867 nt, Artificial Sequence
  derived and/or modified CDS sequence (wt) from DENV-4__FJ850095__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguugagaaccuauugcauugaagccuuaauaucaaacauaacuacggcaacaagauguccaacgcaaggagagccuuaucugaaagaggaacaggaccaacaguacaucugccggagagaugugguagauagaggauggggcaauggcuguggcuuguuuggaaaaggaggaguugugacaugugcgaaguucucaugcucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaacuagaacccccuuuuggggacagcuacauagugauagguguuggaaacagcgcacuaacacuccauugguucaggaaagggaguuccauuggcaagauguuugaguccacauacagaggugcaaaacgcauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaagggcaagagagcacucacacccccagcgagugaucugaaauauucauggaagacauggggaaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacauuguggagcaauggagugcuggaaagccagaugcucauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggaggauugugaccauagaggcccaucuuugaggaccaccacugcaucuggaaaacuagucacgcagugguguugccgcuccugcacgaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucacuaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggggguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccagucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagagauuggagcaguaacauuagauuucaaaccuggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgaaauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaauuugccaguggaaggaagaguauaacucucgacaucuuaacagagaucgccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaauuauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaauacgucggccaaccuaucuuuagcagccaucgccaaccaggcagccguucuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucacuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguacugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggauacaagaaucacugaggaugaccuucaaaaugaggaacugaucacggaacagauggcuccccaccacaagauccuagccaaagccaucuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaggacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaccugaucggaaaagaggaauacguggauuacaugccaguaaugaaaagauacagugcuccuucagagagugaaggaguucuguaa

SEQ ID NO: 7833 - RNA, 9867 nt, Artificial Sequence
  derived and/or modified CDS sequence (wt) from DENV-4__FJ639748__SS-prME
ucaacgaugacauuguugugcuugauucccaccgcaauggcguuucacuugucaacaagagauggcgaaccccucaugauaguggcaaaacaugaaagagggagaccucucuuguuuaagacaacagaggggaucaacaaaugcacucucauugccauggacuugggcgaaaugugugaggauacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacuccacauucaggaaugggauuggaaacaagagcugagacauggaugucaucggaaggggcuuggaagcaugcucagagaguagagagcuggauacucagaaacccaggauuugcgcuccuggcaggauucauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggagggugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaagaacaggaccaacaguacaucugccggagggaugugguagacagaggauggggcaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccgucgguagaaguccaauugccggacuauggagaacuaacacuagauugugaacccaggucuggaauugacuuuaaugagaugauccuaaugaaaaugaaaaagaaaacauggcucgugcauaagcaaugguuuuuggaucugccucuuccauggacagcaggagcagacacaucagagguucacuggaauuacaaagagagaauggugacauucaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgaugugcucaggaaaguuuucaauugacaaagagauggcagaaacacagcaugggacaacaguggugaaagucaaguaugaaggugcuggagcuccguguaaaguccccauagagauaagagauguaaacaaggaaaaagugguagggcgcguuaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaucagguuuuuggaaguguguauacaaccauguuuggaggagucucauggaugauuagaauccuaauugggcucuuaguguuguggauugguacgaacucaaggaacacuucaauggccaugacaugcauagcuguuggaggaaucacucuguuucugggcuucacaguucaagcggacguggguuguguggugucauggagugggagagaauugaaguguggaagcggaauuuuuguaguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaaugaacuaaacuauguucucugggaaggaggacaugaucucacuguaguggcuggggaugugaaggggguguugaccaaaggcaagagagcacucacacccccagugagugaucugaaauauucauggaagacauggggaaaagcaaaaaucuucaccccugaagcaagaaacagcacauuuuugauagacggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccguuccugcacaaugccccccuuaagguucuugggagaagaugggugcugguaugggauggagauuaggcccuugagugaaaaagaagagaacaugguuaaaucacaggugacggccggacagggcacaucggaaacuuuuucuaugggucuguugugccuaaccuuguuuguggaagaaugcuugaggagaagagucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauaugugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcgauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguacagguccucgcuauagaaccaggaaaaaaucccaaacauguccaaacgaaaccuggccuuuucaaaacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagcccuaaaaaggaggcugcgaacuuugauuuuggcucccacaagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagauccauuuccccagagcaacagcccaauagaagacaucgagagagagauuccggaaaggucauggaacacaggguucgacuggauaacagacuaccaagggaaaaccgugugguuuguucccagcauaaaagcuggaaaugacauugcaaauuguuugagaaagucgggaaagaaaguuauccaguugaguagaaaaaccuuugauacagaauauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccaguaacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauugaugaggagaggagaccuuccaguguggcugagcuauaagguagcuucugcuggcauuucuuacaaagaucgggaauggugcuucacuggggaaagaaacaaccaaauuuuagaagaaaacauggagguugaaauuuggacuagagagggagaaaagaaaaaacugaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcuugcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauauuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacuccuaugcugagacacaccauagaaaacacgucggccaaccuaucucuagcagccaucgccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaagcaaaagccacaagggaggcccagaaaaggacagcugcuggaauuaugaaaaauccuacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggaaggcaacccgggaagguuuuggaacacgaccauagccguauccaccgccaacauuuucaggggaaguuacuuggcgggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcauuaaaguccuuaaccccuacaugccaacagucauagaagagcuggagaaacugcagagaaaacauggugggaaccucgucagaugcccgcuguccaggaacuccacccaugagauguauugggugucaggagcgucgggaaacauugugagcucugugaacacaacaucaaagauguuguugaacagguucacaacaaggcauaggaaacccaccuaugagaaggacguagaucuuggggcaggaacgagaagugucucuacugaaacagaaaaaccagacaugacaaucauugggagaaggcuucagcgauugcaagaagagcacaaagaaacauggcauuaugaucaggagaauccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaucaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcuguuaaugacagucgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuagaauuugaagcccuggguuuuuugaaugaagaucacugguuuggcagagaaaauucauggaguggaguggaaggggaaggccugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaagguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaauccaaaaggguugaaagaaagaguugagaaauggcugagagaguguggugucgacagguuaaaaaggauggcaaucaguggagacgauugcguggugaagccccuagaugagagguuugccacuucccuccucuuccugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacccaggucaggaaccugaucggaaaagaggaauacguggauuacaugccaguaaugaaaagauacagugcuccuucagagaaugaaggaguucuguaa

SEQ ID NO: 7834 - RNA, 9867 nt, Artificial Sequence
  derived and/or modified CDS sequence (wt) from DENV-4__FJ639764__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaccaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggccuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccuuaauaucaaacauaacuacggcaacaagauguccaacgcaaggagagccuuaucugaaagaggaacaggaccaacaguacaucugccggagagaugugguagacagaggauggggcaauggcuguggcuuguuuggaaaaggaggaguugugacaugugcgaaguuuucauguucggggaagauaacaggcaaucugguccaaauugaaaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaaccuaggucuggaauugacuuuaaugagaugauccuaaugaaaaugaaaaagaaaacauggcucgugcauaagcaaugguuuuuggaucugccucuuccauggacagcaggagcagacacaucagagguucauuggaauuacaaagagagaauggugacauuuaagguuccucaugcuaagagacaggaugugacagugcuaggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggcgcuggagcuccgugcaaaguccccauagagauaagagauguaaacaaggaaaaagugguugggcgcguuaucucauccaccccucuggcugagaauaccaacaguguaaccaacauagaauuagaaccccccuuuggggacagcuacauagugauagguguuggaaacagcgcauuaacacuccauugguuuaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaaucggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggauagaacaguacaaauuccaaccagaguccccagcgagacuagcguccgcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaggggguguugaccaaaggcaagagaacacucacacccccggugagugaucugaaauauucauggaagacauggggaaaagcaaaaaucuucaccccugaagcaagaaacagcacauuuuuaauagauggaccagacaccucugaaugccccaaugaacgaagagcauggaauucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagacuuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccguggguccauggcacuuaggcaaacuagagauagacuuuggagaaugccccggaacaacagucacaauucaggaggauugugaccauagaggcccaucuuugaggaccaccacugcaucuggaaaacuagucacgcaaugguguugccgcuccugcacgaugccccccuuaagguucuugggagaagaugggugcugguaugggauggagauuaggcccuugagugaaaaagaagagaacauggucaaaucacaggugacggccggacagggcacaucggaaacuuuuucuaugggucuguugugccugaccuuguuuguggaagaaugccugaggagaagggucacuaggaaacacaugauauuagcugugguaaucacucuuugugcuaucauccuggggggccucacauggauggacuuguuacgagcccuaaucauguugggggacacuaugucugguagaauaggaggacagacccaccuagccaucauggcaguguucaagaugucaccaggauaugugcuggguguguuuuuaaggagacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucguuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagacaaaugggacaaagaagaagacguucagguccucgcuguagaaccaggaaaaaaucccaaacauguccaaacgaaaccuggccuuuucaagaccauaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagguugacuauaauggacuuacaccccggagcuggaaagacaaaaagaauucuuccaucaauagugagagaagcccuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuucugucaucaaccaggguuccaaauuacaaccuuauaguaauggaugaagcacauuucaccgauccuuccagugucgcggcuagaggauacauuucgaccaggguagaaaugggagaggcagcagccaucuucaugaccgcaaccccucccggagcgacagaucccuuuccccagaguaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacagacugggacuuuguggucacuacagauauaucugaaaugggggcuaauuuuagagcugggagagugauagacccuagaagaugccucaagccaguuauccuaacagaugggccagagagaguuauuuuagcagguccuauuccagugacuccagcaagcgcugcucagagaagagggcgaauagggaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuggaugcacguguauacgcugaccccauggcuuugaaggauuucaaggaguuugccaguggaaggaagaguauaacucucgacauccuaacagagauugccaguuugccaacuuaccucuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgacguggacuugagaccagcuucagcauggacgcucuaugcgguagccaccacaauucuaacucccaugcugagacacaccauagaaaacacgucggccaaccuaucucuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaauuaugaaaaaucccacaguggacgggauaacaguaauagaucuagaaccaauauccuaugacccaaaauuugaaaagcaauuagggcaggucaugcuacuaguuuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagaggcaugguaaaaccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacauccaagauguuguugaacagguuuacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaagccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaaucaguggagacgauugcguggugaagccccuagacgagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccuaggcaaagcuuacgcccagauguggucgcuuauguacuuccacagaagggaucugcguuuagccucuauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucaugggaagauauaccuuaucuagggaaaagagaggauuugugguguggaucccugauuggacuuucuucuagagccaccugggcgaagaacauucacacggccauuacucaggucaggaaccugaucggaaaagaggaauacguggauuacaugccaguaaugaaaagauacagugcuccuucagagagugaaggaguucuguaa

SEQ ID NO: 7835 - RNA, 9867 nt, Artificial Sequence
  derived and/or modified CDS sequence (wt) from DENV-4__FJ639773__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaauguacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacuuagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacugcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagagauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcgucaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguuggaggaaucacucuguuuuugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaggggguguugaccaagggcaagagagcacucacacccccagcgagugaucugaaauauucauggaagacauggggaaaagcaaaaaucuucaccccugaagcaagaaacagcacauuuuuaauagacggaccagacaccucugaaugccccaaugaacgaagagcauggaauucauuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggaggauugugaucauagaggcccaucuuugaggaccaccacugcaucuggaaaacuagucacgcaaugguguugccgcuccugcacgaugccccccuuaagguucuugggagaagaugggugcugguaugggauggagauuaggcccuugagugaaaaagaagagaacaugguuaaaucacaggugacggccggacagggcacaucggaaacuuuuucuaugggccuguuaugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguuuaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccagucacaaugaccuuaugguacauguggcaagugaaaacacaaagaucaggagcccugugggacgucccuucacccgcuaccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccagaccccagcugugaaaucagaacacacaggaagagagauuguagaccucaugugccaugcaaccuucacaacaagacuuuugucaucaaccaggguuccaaauuacaaccuuauaguaauggaugaagcacauuucaccgauccuuccagugucgcggcuagaggauacauuucgaccaggguggaaaugggagaggcagcagccaucuucaugaccgcaacuccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggccucaauuauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccaggaaaaaacagaaaccaccauccucgauguggacuugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggaggguaacccgggaagguuuuggaacacgaccauagccguauccaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaaaccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggacguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaggaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaauuuggcagagccaagggaagccgagcaaucugguacauguggcugggagcgcgguuucuggaauuugaagcccuggguuuuuugaaugaagaucacugguuuggcagagaaaauucauggaguggaguggaaggggaagguuugcacagauugggauacauccuggaggagauagacaagaaggauggagaccuaauguaugcugaugacacagcaggcugggacacaagaaucacugaggaugaccuucaaaaugaggaauugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauauggcuugaacacauucaccaacauggaaguucaacucauccgccagauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauaucccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7836 - RNA, 9867 nt, Artificial Sequence
  derived and/or modified CDS sequence (wt) from DENV-4__FJ882580__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccuuacguccaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucuuaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaagagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaaucuuugugguugacaacgugcacacuuggacagaacaguacaaauuccaaccagaguccccagcgagacuagcgucugcaauauuaaaugcccacaaagauggggucuguggaauuagaucaaccacaaggcuggaaaauguuauguggaagcaaauaaccaaugagcuaaacuauguucucugggaaggaggacaugaucucacuauaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggccuguugugccugaccuuguuuguggaagaaugcuugaggagaagagucaccaggaaacacaugauauuagccgugguaaucacucuuugugcuaucauccuggggggccucacauggauggacuugcuacgagcccucaucauguugggggacacuaugucugguagaauaggaggacagacccaccuagccaucauggcaguguucaagaugucaccgggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugccuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuugggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacacaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagauccuuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccagcuugccaacuuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggauguuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaaguuuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggggaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7837 - RNA, 9867 nt, Artificial Sequence
  derived and/or modified CDS sequence (wt) from DENV-4__FJ882581__SS-prME
ucaacgauaacauuguugugcuugauucccaccguaauggcguuucacuugucaacaagagauggcgaaccccucaugauaguggcaaaacaugaaagggggagaccucucuuguucaagacaacagaggggaucaacaaaugcacucucauugccauggacuugggugaaaugugugaggacacugucacguauaaaugcccccuacuggucaauaccgaaccugaagacauugauuguuggugcaaccucacgucuaccugggucauguaugggacaugcacccagagcggagaacggagacgagagaagcgcucaguagccuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuacaugauugggcaaacagggauccagcgaacugucuucuuuguccuaaugaugcuggucgccccauccuacggaaugcgaugcguaggagugggaaacagagacuuuguggaaggagucucagguggagcaugggucgaccuggugcuagaacauggaggaugcguuacaaccauggcccagggaaaaccaaccuuggauuuugaacuaaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacagugugaccaacauagaauuagaaccccccuuuggggacaguuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcuguacaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggaaugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaaaacaugggggaaagcaaaaaucuucaccccugaagcaagaaacagcacauuuuuaauagacggaccagacaccucugaaugccccaaugaacgaagagcguggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggcuggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacuuauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguggggauacacauggaagguguauuucacacaauguggcauguuacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaaggauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaaccuagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaaaguagcuucugcuggcauuucuuacaaagaucgggaauggugcuucacuggggagagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugauaacauaguuaugcuucacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcggccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuucacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaagaacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccuuggcucucuucaaaaccugaauucugcaucaaaguccuuaaccccuacaugccaacagucauagaagagcuggaaaaacugcagagaaaacauggugggaaccuugucagaugcccgcuguccaggaacuccacccaugagauguauugggugucaggagcgucgggaaacaucgugagcucugugaacacaacaucaaagauguuguugaacagguucacaacaaggcauaggaaacccacuuaugagaaggacguagaucuuggggcaggaacgagaagugucuccacugaaacagaaaaaccagauaugacaaucauugggagaaggcuucagcgauugcaagaagagcacaaagaaacauggcauuaugaucaggaaaauccauacagaaccugggcguaucauggaagcuaugaagcuccuucgacaggcucugcguccuccauggugaacgggguggugaaacugcuaacaaaacccugggauguaauuccaauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacuagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcauagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguugggacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagaaguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucuacgucuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7838 - RNA, 9867 nt, Artificial Sequence
  derived and/or modified CDS sequence (wt) from DENV-4__FJ882582__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagccuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuacaugauugggcaaacagggauccagcgaacugucuucuuuguccuaaugaugcuggucgccccauccuacggaaugcgaugcguaggagugggaaacagggacuuuguggaaggagucucagguggagcaugggucgaccuggugcuagaacauggaggaugcguuacaaccauggcccagggaaaaccaaccuuggauuuugaacuaaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguucgcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacagugugaccaacauagaauuagaaccccccuuuggggacaguuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcuguacaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggaaugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaaaacaugggggaaagcaaaaaucuucaccccugaagcaagaaacagcacauuuuuaauagacggaccagacaccucugaaugccccaaugaacgaagagcguggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccacacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggcuggacagggcacaucggaaacuuuuucuaugggucuguuaugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguggggauacacauggaagguguauuucacacaauguggcauguuacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaaggauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaaccuagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaaaguagcuucugcuggcauuucuuacaaagaucgggaauggugcuucacuggggagagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugauaacauaguuaugcuucacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuucacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaagaacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccuuggcucucuucaaaaccugaauucugcaucaaaguccuuaaccccuacaugccaacagucauagaagagcuggaaaaacugcagagaaaacauggugggaaccuugucagaugcccgcuguccaggaacuccacccaugagauguauugggugucaggagcgucgggaaacaucgugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaauccauacagaaccugggcguaucauggaagcuaugaagcuccuucgacaggcucugcguccuccauggugaacgggguggugaaacugcuaacaaaacccugggauguaauuccaauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacuagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcauagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguugggacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagaaguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucuacgucuagccuccauggccauaugcucagcaguuccaacggaaugguuuccaacaagcagaacaacauggucaauccaugcucaucaccaauggaugaccacugaagacaugcucaagguauggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacgcggauuacaugccaguaaugaaaagauacagugcuccuucagagagugaaggaguucuguaa

SEQ ID NO: 7839 - RNA, 9867 nt, Artificial Sequence
  derived and/or modified CDS sequence (wt) from DENV-4__FJ882584__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccuuacguccaccugggucauguaugggacgugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacuuuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccucaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugaaaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcaggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacauggucaaaucacaggugacggccggacagggcacaucggaaacuuuuucaaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccgggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgccgccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggaguggucaccaaaucaggugauuacgucagugccauaacacaagccgaaagaauuggagagccagauuaugaaguggaugaggacauuuuucgaaagaaaagacuaacuauaauggacuuacaccccggagccggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaccaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuuuacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacaugcccugaacgaacuuccggagucacuggaaacacucaugcuuguagccuuacuaggagcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaaguuuugacuuuggccacaggaccaaucuugaccuugugggagggcaacccgggaagguuuuggaacacgaccauagccguaucuaccgccaacauuuucaggggaaguuauuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucucggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaaaaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcuauuaguggagacgauugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucagaaaucugaucggaaaagaggaauacguggauuacaugccaguaaugaaaagauacagugcuccuucagagagugaaggaguucuguaa

SEQ ID NO: 7840 - RNA, 9867 nt, Artificial Sequence
  derived and/or modified CDS sequence (wt) from DENV-4__FJ882585__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguuggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauuguauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguagggaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauauacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuuaggcaaacuagagauagacuuuggagaaugccccggaacaacagucacaauucaggagaacugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaccauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaagguauaauggcuguggguuuggucagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagccauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugagaaagucgggaaagaaagucauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacggaagcgaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugaguuauaagguagcuucugcuggcauuuccuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguacaacucucgacauccugacagagaucgccaguuugccaacuuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacaugguggaaaccuugucagaugcccgcuguccaggaacuccacccaugagauguauugggugucaggagcgucgggaaacauugugagcuccgugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacgccgcaaccaaaaccaggcacacgaaugguuaugaccacgacagccaauuggcuaugggcccuccuuggaaagaagaaaaaucccagacugugcacaaaggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgacugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugacugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7841 - RNA, 9867 nt, Artificial Sequence
  derived and/or modified CDS sequence (wt) from DENV-4__FJ882586__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgcugcguaggaguaggaaacagagacuuuguggaaggagucucagguggagcaugggucgaccuggugcuagaacauggaggaugcgucacaaccauggcccagggaaagccaaccuuggauuuugaacugaccaagacaacagccaaggaaguggcuuugcuaagaaccuauugcauugaagccuuaauaucaaacauaacuacggcaacaagauguccaacgcaaggagagccuuaucugaaagaggaacaggaccaacaguacauuugucggagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguagugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaaucuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguuuaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauuacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucauacaauguggcaugucacaagaggaucggugauuugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaacuccagcugugaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuaucccagugacuccagcaagcgcugcccagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaucuuccgguguggcugaguuauaagguagcuucugcuggcauuucuuacaaagaucgggaaugguguuucacuggggaaagaaauaaccaaauuuuagaagaaaacauggagguugaaauuuggacuagagagggagaaaagaaaaaacugagaccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuucacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguggccaccacaauucugacucccaugcugagacacaccauagaaaacacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauuccaauggcuacuuauggcuggaauuuggucaaacuccauucagggguugacguguucuacaaacccacagagcaaguggacacccugcucugugauauuggggagucaucuuccaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaagacuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguuuaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaaugcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaaugaagaccauugguuuggcagagaaaacucauggaguggaguggaaggggaaggucugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggacaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauucaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauagcucaggucaggaaucugaucggaaaagaggaauacguggauuacaugccaguaaugaaaagauacagugcuccuucagagagugaaggaguucuguaa

SEQ ID NO: 7842 - RNA, 9867 nt, Artificial Sequence
  derived and/or modified CDS sequence (wt) from DENV-4__JN819406__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccuuacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugcgagagaauugaaguguggaagcggaauuuuugugguugacaacgugcacacuuggacagaacaguaucaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggaguguuggaaagccagaugcuuauuccaaaaucauacgcgggcccuuuuucacagcacaauuaccgccagggcuaugcuacgcaaaccguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacucucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacacaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuuuaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauugcuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuuuacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacacgcccugaacgaacuuccggagucacuggaaacacuuaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccguuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuagguuuuuugaaugaagaucacugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaagggcugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccauccaagggauggaaaaacuggcaagagguuccuuuuugcucccaccacuuucacaagaucuuuaugaaggauggccgcucacuagucguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7843 - RNA, 9867 nt, Artificial Sequence
  derived and/or modified CDS sequence (wt) from DENV-4__GQ199876__SS-prME
ucaacaauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuacuugggucauguaugggacauguacccagagcggagaacggagacgagagaagcgcucaguagcuuuaacaccacauucaggaaugggauuggaaacaagagcugaaacauggaugucaucggaaggggcuuggaaacaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauuguauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguagggaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagaggauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauugagauaagagauguaaacaaggaaaaagugauugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcuagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuugggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacauuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggccguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggaugucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaaccauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaguccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacggaagcgaagauguugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaaucuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacacgcccugaacgaacuuccggagucacuggaaacacucaugcuuguagccuuauuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccggaaaaacaaaggaccccacaagacaaucaauugaucuacgucauauugaccauucucaccauuauuggucuaauagcagccaacgagauggggcugauagaaaaaacaaaaacggauuuuggguucuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaacccugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacaucuucagaggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggauauacaaaaggagguccaggacaugaagaaccgauucccauggcuacuuauggcuggaauuuggucaaacuccauucagggguugacguguucuacaaacccacagagcaaguggacacccugcucugugauauuggggagucaucuuccaauccaacaauagaggaaggaagaacauuaagaguuuugaagaugguggagccauggcucucuucaaaaccugaauucugcaucaaaguccuuaaccccuacaugccaacaguuauagaagagcuggagaaacugcagagaaaacauggugggaaccuugucagaugcccgcuguccaggaacuccacccacgagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaagcugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugacuacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccagaaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgacugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugacugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7844 - RNA, 9867 nt, Artificial Sequence
  derived and/or modified CDS sequence (wt) from DENV-4__KP723482__SS-prME
ucaacaaugacauugcuguguuugauucccaccguaauggcguuucaccugucaacaagagauggcgaaccccucaugauaguggcaaaacacgaaagggggagaccucucuuguucaagacaacagaaggaaucaacaaaugcacccucauugccauggaccugggugaaaugugugaagacacugucacguauaaauguccucuacuggucaacaccgaaccugaagacauugauugcuggugcaaucucacguccaccugggucauguacgggacauguacccagagcggagaacggaggcgagaaaagcgcucaguagcuuuaacaccacauucaggaaugggauuggaaacaagagcugagacauggaugucaucggaaggggccuggaaacaugcucagagaguggaaagcuggauacucagaaacccaggauuugcgcuccuggcaggauuuauggcuuauaugauugggcaaacaggaauccagcgaacugucuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagcuaaagaaguggcucuguuaagaaccuauugcauugaagcuucgauaucgaacauaaccacggcaacaagauguccaacgcaaggagagccuuaucucaaagaggaacaagaccagcaguacauuugccggagagauguaguagauagaggguggggcaaugguuguggcuuguuuggaaaaggaggaguugugacaugugcgaaguuuuuaugcucggggaagauaacaggcaaucugguccaaauugaaaaccuugaauauacgguaguugugacaguccacaauggaaacacccaugcaguaggaaaugacacaucuaaucauggagugacagccacgauaacucccaggucaccaucgguagaagucaaauugccggacuauggagaacuaacacuugauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucaugccaagagacaggaugugacagugcuaggaucucaggagggagccaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaaugucauguggaagcaaauaaccaacgagcuaaacuauguucucugggaaggaggacaugaccucacaguaguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagauaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcaggcccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacugcaucuggaaaacuagucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugaccuuguucguggaagaaugcuuaaggagaagagucacuaggaaacacaugauauuggcugugguaaucaccuucugugcuaucauccuaggaggucucacauggauggacuuacuacgaguccuuaucauguuaggggacacuaugucugguagaauaggaggacagauucaccuagccaucauggcaguguucaagaugucaccaggauaugugcuggguguguuuuuaaggaaacuuacuucaagagagacagcguuaaugguaauaggaauggccaugacaacgguguuuucaauuccacaugaucucauggaacucauugauggaauaucauugggguugauauuacuaaaaauaguaacacacuuugauaacacccaagugggaacuuuagcccuuucccugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucucaaugagggcauaauggcugugggucuggugagccucuuaggaagcgcccucuuaaagaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccgaucauagaagugaagcaggaugaagauggcucuuucuccauacgggacgucgaggaaaccaacaugauaacccucuuggugaaacuagcgcugauaacaguaucaggucuuuaccccuuggcaauuccaguuacaauggcacuaugguauguuuggcaagugaaaacacaaagaucaggagcucugugggacguccccucacccucugccacucagaaagccacacugucugaagggguguauaggauuaugcaaagaggguuguucgggaaaacucagguuggaguggggauacacauggaagguguauuccacacaauguggcacguaacaagaggaucagugaucugccaugagacagggagauuagagccaucuugggcugacgucaggaaugacaugauaucauacggugggggauggaggcucggagacaagugggacaaagaagaagauguucagguccuagccauagaaccaggaaaaaauccuaaacauguccaaacgaaaccaggccuuuucaagaccuuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacaucuuccgaaagaaaagauuaaccauaauggacuuacaccccggagccgggaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacggugugguuuguucccagcauaaaagcuggaaaugacauugcaaauuguuugagaaagucgggaaagagagugauccaguugagcagaaaaaccuuugacacagaguauccaaagacgaaacucacggacugggauuuuguggucaccacagacauaucugaaaugggagccaauuucagagcugggagagugauagaccccaggagaugccucaagccaguuauccugacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacauuguuugguccggaaagggaaaaaacccaagcuauugauggagaguuucgccucagaggggaacaaaggaagacuuuuguggaauugaugaggagaggagaccuuccgguguggcugagcuacaagguagcuucugccgguauaucuuacaaagaccgagaauggugcuucacaggggaaaggaauaaccaaauuuuagaagaaaacauggagguugaaauauggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccauuauuggucuuauagcagccaaugagauggggcugauugaaaaaacaaaaacggacuuuggguucuaccagguaaaaccagaaaccaccauucuugauguggauuugagaccagccucagcguggacacucuaugcaguggccaccacuauucugacucccaugcugagacacaccauagagaacacgucugccaaccuaucucuagcagccauugccaaccaagcagcuguccuaaugggacuuggaaaaggauggccgcuccacaggauggaucucggugugccgcugcuagcaaugggaugcuauucucaagugaacccaacaaccuugacagcaucccuaguuaugcucuuaguucauuaugccauaauagguccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaaguacugacucuggccacaggaccagucaugaccuugugggagggcaacccgggaagguuuuggaacacaaccauagcuguauccacagcuaacauuuuuagaggaagcuacuuggcgggagcuggacuagcuuucucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaagagauggaaccaaaaucaaguaugcgguguccagagggucuaguaagaucagauggauuguugaaagaggaaugauaaaaccaaaaggaaaggucguagaucuugguugcgggaggggaggaugguccuauuacauggcgacgcucaagaacgugacugaagugaaaggauauacuaaaggagguccaggacacgaagaaccaauccccauggcuaccuauggcuggaauuuggucaaacuccauucaggaguugauguguucuacaaacccacagagcagguggacacccugcuuugugacauuggggagucauccucuaauccgacaauagaagaaggaagaacauugagagucuugaagaugguggagccauggcucucuucaaaaccugaguucugcauaaaaguccucaaccccuacaugccgacaguuauagaagagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacagucauugggagaaggcuucagagauugcgagaagagcacaaagaaaccuggcacuaugaccaggaaaacccauacagaaccugggcguaucauggaagcuaugaagcuccuucgacaggcucagcauccuccauggugaacgggguaguaaaacugcugacaaaaccuugggaugugauuccaauggugacucaguuggccaugacagacacaaccccuuuugggcaacaaagaguguucaaggagaagguggauaccagaacaccacaaccaaaacccggcacacggaugauuaugaccacgacagccaauugguugugggcccuccucgggaagaagaaaagcccuagacugugcacaagggaagaguucaucucaaaaguuaggucaaaugcagccauaggcgcagucuuccaggaagaacagggauggacaucagccagugaagcugugaaugacagccgguucugggaacugguugacaaagaaagggcucugcaccaggaaggaaaaugugaaucgugcgucuacaacaugaugggaaagcgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggggaaggucugcacagauugggauacaucuuggaggacauagacaagaaggauggagaccugauauaugcugacgacacagcaggcugggacacgaggaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaccaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagaguguggcgucgacagguugaagaggauggcaaucaguggagaugauugcguggugaagcccuuagaugagagguuuagcaccucccuccucuucuugaaugacaugggaaaggugaggaaagauaucccgcagugggaaccauccaagggauggaaaaacuggcaagagguuccuuuuugcucccaccauuuccacaagaucuucaugaaagauggccgcucacuaguuguuccaugcagaaaccaggaugaacugauaggaagagccagaaucucgcagggggcuggauggagcuugagagagacagccugucugggcaaagcuuacgcccaaauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaaccccaauaugacugacaagacuccaguccauucgugggaagacauaccuuaccuagggaaaagagaggaucuguggugcggaucccugauuggacuuucuuccagagccaccugggcgaagaauauucacacggcuauaacccaggucaggaaucugaucggaaaagaggaauauguggauuacaugccagccaugaaaagauacagcgcuccuuucgagagugaaggaguucuguaa

SEQ ID NO: 7845 - RNA, 9867 nt, Artificial Sequence
  derived and/or modified CDS sequence (wt) from DENV-4__JN638570__SS-prME
ucaacaauaacacugcugugcuugauucccacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugcgaggacaccgucacguauaaaugccccuuacuggucaauaccgaacccgaagacauugauugcuggugcaaucucacgucugccuggguuauguaugggacaugcacccaaaguggagaacgaaggcgagagaagcgcucaguagcucuaacaccacauucaggaaugggauuggaaacaagggcugaaacauggaugucaucggaaggagccuggaaacacgcccagaggguagagaguuggauacucagaaacccaggauucgcgcucuuggcaggguuuauggcauacaugaucgggcaaacaggaauccagcgaacagucuucuucauucuaaugauguuggucgccccaucuuacggaaugcgaugcguaggaguagggaacagagacuuuguagaaggagucucagguggagcaugggucgaucuggugcuagaacauggaggaugugucacuaccauggcccagggaaagccaacuuuggauuuugaacugaucaagacaacagccaaggaaguggcccuguuaagaaccuauugcauugaagcuuccauaucaaacauaaccacagcaacaagauguccaacgcaaggagagccuuaccucaaagaggaacaagaucaacaguacauuugccggagagacaugguagauagaggguggggcaacggcuguggcuuguuugggaagggaggaguugugacaugugcgaaguuuucaugcuuggggaagauaacgggcaacuuaguccaaauugagaaccuugaauacacagugguuguaacaguccacaauggagacacucacgcuguaggaaaugacacaucuaaccauggagugacagccacgauaacucccaggucaccaucgguugaaguuaaauuaccggacuauggagaauugacacuugacugugaaccuagauccggaauugacuuuaaugagaugauucugaugaaaaugaaaacgaaaacguggcucgugcacaagcaaugguuuuuggaucuaccucuaccauggacaacaggagcagacacgcuagaaguucacuggaaucacaaagagagaauggugacauuuaagguuccucaugccaagagacaggaugugacagugcuaggaucucaggaaggagccaugcauucagcccucgccggagccacagaaguggauuccggugauggaaaccauauguuugcaggacacuuaaaguguaaaguucguauggaaaaguugaggaucaagggaaugucauacacgaugugcucaggaaaguucucaauugauaaagagauggcagaaacacagcauggaacaacagugguaaaggucaaguaugaggguacuggagcuccauguaaaguucccauagagauaagagaugugaacaaggaaaaagugguugggcgcauuaucucauccaccccuuuugcugagaauaccaacagugugaccaacauagaauuggaaccuccuuuuggggauaguuacauagugauaggugugggagacggugcauuaacacuccauugguucaggaaagggagcuccauuggcaagauguuugaguccacauacagaggugcaaagcgcauggccauucuaggugaaacagcuugggauuuugguuccguugguggacugcucacgucauuaggaaaggcuguacaccagguuuuuggcaguguguacacaacuauguuuggaggagucucauggauggucagaauccuaaucgggcucuuaguguuguggauugguacgaauucaagaaacacuucaauggcuaugucgugcauagcuguuggaggaaucacccuguuucugggcuucacaguccaugcagacauggguuguguggugucauggagugggaaagaguugaaauguggaagcggaauuuuuguaauugacaacgugcacacuuggacagaacaguacaaauuucaaccagagucuccagcgcgacuggcgucggcaauacugaaugcccacaaagaaggggucuguggaauuagaucaaccacaaggcuggaaaaugucauguggaaacaaauaacuaaugaguuaaacuauguucucugggaaggaggacaugaccucacuguaguggccggggaugugaaagggguguuguccaaaggcaagagagcacucgcaccuccagugaaugaccugaaauauucauggaagacaugggggaaagcaaagaucuuuacuccagaaacaagaaacagcacauuuuugguggacggaccagacaccuccgaaugccccaaugaacgaagagcauggaacuuucuugagguggaagacuauggauuuggcauguucacgaccaacauauggaugaaauuucgagaaggaaguccagaagugugugaccauaggcugaugucagcagcaaucaaagaccagaaagcugugcaugcugauaugggcuauuggauagagagcucaaaaaaccagaccuggcagauagagaaggcaucccucauagaagugaaaacaugucuguggcccaagacccacacauuguggagcaauggagugcuggaaagccagaugcucaucccaaaagcauaugcaggcccuaucucacagcacaacuaucgccaaggcuaugccacgcagaccgcgggcccauggcacuugggcaaauuggaaauagacuuuggagaaugccccggaacaacagucacuguacaagaggauugugaccauagaggcccaucuuugaggaccaccacugcaucuggaaaauuggucacgcaguggugcugucgcuccugcacgaugccucccuuaagauuuuuaggagaggauggaugcugguaugggauggaaaucaggcccuugaaugaaaaagaagagaacauggucaaaucacagguuucagccggacaggguacaucagagacuuuuucuauggggcuguugugccugacuuuguuuguggaagaaugcuugaggagaagagucaccaggaaacacaugauguugguuguggugaccacccuuugugccaucauuuuaggaggucuuacauggauggacuuacugcgugcccucaucaugcuaggggacaccaugucugguagaauggggggacaaauucaucuagccaucauggcaguguucaagaugucaccaggauacguguuggguauauuucugaggaaacucaccucaagagagacagcacugaugguaauaggaauggccaugacaacggugcuugcaauuccacaugaccuuauggaauuuauugauggaauaucauuaggguuaauuuuauuaaaaaugguaacacauuuugacaacacucaagugggaaccuuagcccuugccuuaaccuucauaaaaucaacaaugccauuggucauggcuuggaggaccauaauggcuguguuguuuguggucacacucauuccucuauguaggacaagcugucuucaaaagcagucccauuggguggaaauaacagcacucauccugggagcccaggcucugccaguauaccuaaugacucucaugaaaggagccucaaaaagaucuuggccccuuaacgaggguauaauggcugugggcuuggucagucucuuaggaagcgcccuccuaaagaaugaugucccuuuagcuggcccaaugguggcaggagguuuacuucuggcagccuacgugaugagcggcagcucagcagaccugucacuagagaaggcugccaaugugcggugggaugagauggcagacauaacaggcucaagcccaaucauagaagugaagcaggaugaagauggcucuuucuccauacgggacgucgaggaaaccaacaugauuacccuccuggugaaacuggcacugauaacagugucaggucucuaccccuuggcaauuccagucacaaugaccuuaugguacauguggcaagugaaaacacaaagaucaggagcccugugggacguccccucaccugcugccgcucagaaagcuacacugacugagggaguauacaggaucaugcaaagaggguuguuugggaaaacccagguuggaguagggauacacacggaagguguguuucauacaauguggcauguaacaagaggaucaguaauuugccaugagagugggagacuggagccaucuugggcugacgucaggaacgacaugauaucauauggugggggauggaggcucggagacaaaugggauaaagaagaagauguucaaguucuagcuauagaaccaggaaaaaauccgaaacauguccaaacgaaacccggccucuucaaaacccuuacuggagaaauuggagcaguaacauuggacuucaaacccggaacauccgguucccccaucauuaacaggaaaggaaaagucaucggacucuacggaaaugggguaguuaccaaaucaggugauuacguuagugccauaacacaagcugaaagaauuggugagccagacuaugaaguggaugaggacauuuuccgaaagaaaagauuaaccauaauggauuuacaucccggagccggaaagacaaaaagaauccucccaucaauaguuagagaagccuuaaaaaggaggcugcgaaccuugauucuggcucccacgagagugguggcggccgaaauggaagaagcgcuacguggacugccaauccguuaucagaccccagcugugaaaucagaacacacaggaagagagaucguagaccucaugugucaugcaaccuuuacaacaagacuuuuaucaucgaccaggguuccaaauuacaaccucauagugauggaugaagcgcauuucacagacccuucuaguguugcagcuagaggauauaucucaaccaggguggaaaugggagaggcugcagcuaucuuuaugacugcaaccccuccuggaacgacagaucccuucccccagagcaacagcccaauagaagacaucgagagagaaaucccagaaaggucauggaacacaggguuugacuggauaacggacuaccaagggaagacugugugguuuguucccagcauaaaagcuggaaaugacauugcaaauugcuugagaaaaucgggaaagaaggucauccaauugagcaggaaaaccuucgauacagaguauccaaaaacgaaacucacggacugggauuuugugguuaccacagacauaucugaaaugggggccaauuuuagagcugggagagugauagaccccaggagaugccucaagccaguuaucuuaacugaugggccagagagaguuauuuuagcuggucccauuccagugacuccagcaagcgcugcucagagaagagggcgaauagguaggaacccagcacaagaagaugaccaguaugucuucuccggagacccacuaaggaaugaugaagaucaugcccacuggacugaagcaaagaugcuucuugauaauaucuacaccccagaagggaucauuccaacacuguuugguccagaaagggaaaaaacccaagccauugauggagaguuccgccucagaggggagcaaaggaagaccuuuguagaauuaaugaggagaggagaccuuccgguguggcugagcuacaagguagcuucugcugguaucucuuacaaagaccgggaauggugcuuuacgggggaaaggaauaaccaaauucuggaagaaaacauggagguugaaauuuggacuagagagggagagaagaaaaaacucaggccaaaaugguuagaugcacguguuuacgcugaucccauggcucugaaggauuucaaggaguuugccaguggaagaaagagcauaacccucgacaucuugacagaaauugccaguuugccaacguaccuuuccuccagggcuaagcucgcccuugacaacauagucaugcuccauacaacagaaagaggagggaaggccuaccaacacgcucugaacgaacucccagagucacuagaaacacucaugcuuguagcuuuauuaggagccaugacagcaggcaucuuccuauucuucaugcaaggaaaaggaauaggaaaauugucaauggguuugauagccauugcgguagcuaguggcuuacucuggguggcagaaauccagccccaauggauagcggccucaaucauauuggaguuuuuucucaugguguuguugguaccagaaccagaaaaacaaaggaccccacaagacaaucaauugaucuacgucauauugaccauucuuacuauuauugcucucguggcagccaaugagauggggcuaauugaaaaaacaaaaacggauuuuggguuuuaccaggugaaagcagaaaccaccauccuugauguggacuugagaccagcuucagcauggacgcucuaugcaguagcuaccacuaucuugacucccaugcugaggcacaccauagaaaacacgucugcaaacuuauccuuggcugccauugccaaccaagcagccguccugauggggcuuggaaaaggauggccgcuccacagaauggaccucggugugccgcuuuuggcaaugggaugcuauucccaagugaacccaacaacuuuaacagcauccuuagucaugcuucugguccauuaugcaauaauagguccaggauugcaggccaaagccacaagagaggcucaaaaaaggacagcugcugggaucaugaagaaccccacgguggacgggauaacaguuauagaucuagaaccaauauccuaugacccaaaauuugagaagcagcuggggcaagucaugcuacuaguucugugcgcuggacagcuacucuugaugagaacaacaugggccuuuugugaagucuugacucuggccacaggaccaaucuugaccuugugggaaggcaacccgggaagguuuuggaacacgacaauagccguguccacugccaacauuuucaggggaagcuacuuggcgggagcuggauuggccuuuucgcucauaaagaaugcacaaacccccaggaggggaacugggaccacaggagagacacugggagaaaaauggaagagacagcuaaacucgcuagauaggaaggaguuugaagaguacaaaagaaguggaauacuagaaguggacaggacugaagccaagucugcccuaaaagauggguccaaaaucaaguacgcaguguccagagguaccagcaagaucagauggauuguugaaagagggaugguaaagccaaaagggaaaguuguggaucuugguugcggaaggggaggauggucguacuauauggcgacacucaagaacgugaccgaggugaaaggguauacaaaaggagguccaggacaugaggaaccgauucccauggcuaccuauggcuggaacuuggucaaacuccauucagggguugacguguucuacaaacccacugagcaaguggacacuuugcucugugauauuggggagucauccucuaauccgacgauagaggaaggaagaacauuacgaguuuuaaagaugguggagccauggcucucuucaaaaccugaauucugcaucaaaguccucaaucccuacaugccaacagucauagaggagcuggagaaacugcagagacgauaugguggaagucuugucagaugcccgcuauccaggaauuccacucaugagauguauugggugucgggugugucaggaaacaucgugaguucugugaacacaacaucaaagauguuguugaacagauuuaccacaaggcacaggaaacccacuuaugagagggacgcagaccuuggagcaggaacgagaagugucuccaccgaaacagaaaaaccagacaugacaaucaucgggagaagacuccagcgauugcaagaagagcacaaagaaacuuggcacuaugaucaugaaaauccauacagaaccugggcguaucauggaagcuaugaagcucccucgacaggcucagcaucuuccauggugaacgggguaguuaaacugcugacaaaacccugggacgugguuccaauggugacucaguuggcuaugacagauacgacccccuuugggcaacagagaguguucaaggagaagguugacaccagaacaccacagccaaaacccgguacacgaguagucaugaccacgacagccaacuggcuguggacucuccucgggaggaagaaaaaucccagacugugcacaagggaagaauucaucucaaaaguuaggucaaacgcagccauaggcgcagucuuucaggaagaacagggauggacaucagccagugaggcagugaaugacagccgguuuugggaacugguugacaaagaaagggcuuuacaccaggaagggaaaugugaaucaugugucuauaacaugaugggaaaacgugaaaaaaaauuaggagaauuuggcagagccaagggaagccgagcaaucugguacauguggcugggagcgcgguuucuggaauuugaagcccugggcuuuuugaaugaagaucacugguuuggcagagaaaacucauggaguggaguggaaggggaaggucugcauagguugggauacaucuuggaggacauagacaagaaggauggagauuugauauaugcugaugacacagcaggcugggacacaagaaucacugaagaugaccuucugaaugaagagcugaucacggaacagauggccccucaucauaaaauccuagcuaaagccauuuucaaacuaacuuaucaaaacaaagugguaaaaguccucagacccacaccgaaaggagcagugauggacauuauauccaggaaagaucaaagagguaguggacagguuggaacauaugguuugaacacauucaccaacauggaagugcaacucauccgccaaauggaagcugaaggagucauuacacgagaugacaugcauaacccaaaaggguugaaagaaagaguugagaaauggcugaaagaguguggugucgacagguuaaagaggauggcaauuaguggagacgauuguguggugaagccucuagaugagagguucagcacuucccuccucuuuuugaacgacaugggaaaggugaggaaagacauuccgcaaugggaaccauccaagggauggaaaaacuggcaagagguuccuuuuugcucccaccauuuucacaagaucuuuaugaaggauggccguucacuggucguuccauguagaaaccaggaugaacuaauagggagagccagaaucucgcaaggggcuggauggaguuuaagagaaacggccugucugggcaaagcuuacgcccagauguggucgcucauguacuuucauagaagggaccuacguuuagccuccauggcuauaugcucagcagucccaacggaaugguuuccaacaagcagaacaacauggucaauccacgcucaucaucaguggaugacuacugaagauaugcuaaaaguguggaacagaguguggauagaagacaacccuaacaugauugacaaaacuccaguucacucgugggaagauauaccuuaccuagggaaaagagaggauuugugguguggauccuugauuggacucucuucuagggccaccugggccaagaacauucacacagccauaacccaggucaggaaccugaucgggaaagaggaauauguggauuacaugccagccaugagaagauacagcgcucauuucgagagugaaggaguucuguaa

SEQ ID NO: 7846 - RNA, 9867 nt, Artificial Sequence
  derived and/or modified CDS sequence (wt) from DENV-4__JN638571__SS-prME
ucaacaauaacacugcugugcuugauucccacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugcgaggacaccgucacguauaaaugccccuuacuggucaauaccgaacccgaagacauugauugcuggugcaaucucacgucugccuggguuauguaugggacaugcacccaaaguggagaacgaaggcgagagaagcgcucaguagcucuaacaccacauucaggaaugggauuggaaacaagggcugaaacauggaugucaucggaaggagccuggaaacacgcccagaggguagagaguuggauacucagaaacccaggauucgcgcucuuggcaggguuuauggcauacaugaucgggcaaacaggaauccagcgaacagucuucuucauucuaaugauguuggucgccccaucuuacggaaugcgaugcguaggaguagggaacagagacuuuguagaaggagucucagguggagcaugggucgaucuggugcuagaacauggaggaugugucacuaccauggcccagggaaagccaacuuuggauuuugaacugaucaagacaacagccaaggaaguggcccuguuaagaaccuauugcauugaagcuuccauaucaaacauaaccacagcaacaagauguccaacgcaaggagagccuuaccucaaagaggaacaagaucaacaguacauuugccggagagacaugguagauagaggguggggcaacggcuguggcuuguuugggaagggaggaguugugacaugugcgaaguuuucaugcuuggggaagauaacgggcaacuuaguccaaauugagaaccuugaauacacagugguuguaacaguccacaauggagacacucacgcuguaggaaaugacacaucuaaccauggagugacagccacgauaacccccaggucaccaucgguugaaguuaaauuaccggaguacggagaauugacacuugacugugaaccuagguccggaauugacuuuaaugagaugauucugaugaaaaugaaaacgaaaacguggcucgugcacaagcaaugguuuuuggaucuaccucuaccauggacaacaggagcagacacgcuagaaguucacuggaaucacaaagagagaauggugacauuuaagguuccucaugccaagagacaggaugugacagugcuaggaucucaggaaggagccaugcauucagcccucgccggagccacagaaguggauuccggugauggaaaccauauguuugcaggacacuuaaaguguaaaguucguauggaaaaguugaggaucaagggaaugucauacacgaugugcucaggaaaguucucaauugauaaagagauggcagaaacacagcauggaacaacagugguaaaggucaaguaugaggguacuggagcuccauguaaaguucccauagagauaagagaugugaacaaggaaaaagugguugggcgcauuaucucauccaccccuuuugcugagaauacuaacagugugaccaacauagaauuggaaccuccuuuuggggauagcuacauagugauaggugugggagacggugcauuaacacuccauugguucaggaaagggagcuccauuggcaagauguuugaguccacauacagaggugcaaagcgcauggccauucuaggugaaacagcuugggauuuugguuccguugguggacugcucacgucauuaggaaaggcuguacaccagguuuuuggcaguguguacacaacuauguuuggaggagucucauggauggucagaauccuaaucgggcucuuaguguuguggauugguacgaauucaagaaacacuucaauggcuaugucgugcauagcuguuggaggaaucacccuguuucugggcuucacaguccaugcagacauggguuguguggugucauggagugggaaagaguugaaauguggaagcggaauuuuuguaauugacaacgugcacacuuggacagaacaguacaaauuucaaccagagucuccagcgcgacuggcgucggcaauacugaaugcccacaaagaaggggucuguggaauuagaucaaccacgaggcuggaaaaugucauguggaaacaaauaacuaaugaguuaaacuauguucucugggaaggaggacaugaccucacuguaguggccggggaugugaaagggguguuguccaaaggcaagagagcacucgcaccuccagugaaugaccugaaauauucauggaagacaugggggaaagcaaagaucuuuacuccagaaacaagaaacaguacauuuuugguggacggaccagacaccuccgaaugccccaaugaacgaagagcauggaacuuucuugagguggaagacuauggauuuggcauguucacgaccaacauauggaugaaauuccgagaaggaaguucagaagugugugaccauaggcugaugucagcagcaaucaaagaccagaaagcugugcaugcugauaugggcuauuggauagagagcucaaaaaaccagaccuggcagauagagaaggcaucccucauagaagugaaaacaugucuguggcccaagacccacacauuguggagcaauggagugcuggaaagccagaugcucaucccaaaagcauaugcaggcccuaucucacagcacaacuaucgccagggcuaugccacgcagaccgcgggcccauggcacuugggcaaauuggaaauagacuuuggagaaugccccggaacaacagucacuguacaagaggauugugaccauagaggcccaucuuugaggaccaccacugcaucuggaaaauuggucacgcaguggugcugucgcuccugcacgaugccucccuuaagauuuuuaggagaggauggaugcugguaugggauggaaaucaggcccuugaaugaaaaagaagagaacauggucaaaucacagguuucagccggacaggguacaucagagacuuuuucuauggggcuguugugccugacuuuguuuguggaagaaugcuugaggagaagagucaccaggaaacacaugauguugguuguggugaccacccuuugugccaucauuuuaggaggucuuacauggauggacuuacugcgugcccucaucaugcuaggggacaccaugucugguagaauggggggacaaauucaucuagccaucauggcaguguucaagaugucaccaggauacguguuggguauauuucugaggaaacucaccucaagagagacagcacugaugguaauaggaauggccaugacaacggugcuugcaauuccacaugaccuuauggaauuuauugauggaauaucauuaggguuaauuuuauuaaaaaugguaacacauuuugacaacacucaagugggaaccuuagcccuugccuuaaccuucauaaaaucaacaaugccauuggucauggcuuggaggaccauaauggcuguguuguuuguggucacacucauuccucuauguaggacaagcugucuucaaaagcagucccauuggguggaaauaacagcacucauccugggagcccaggcucugccaguauaccuaaugacucucaugaaaggagccucaaaaagaucuuggccccuuaacgaggguauaauggcugugggcuuggucagucucuuaggaagcgcccuccuaaagaaugaugucccuuuagcuggcccaaugguggcaggagguuuacuucuggcagccuacgugaugagcggcagcucagcagaccugucacuagagaaggcugccaaugugcggugggaugagauggcagacauaacaggcucaagcccaaucauagaagugaagcaggaugaagauggcucuuuuuccauacgggacgucgaggaaaccaacaugauuacccuccuggugaaacuggcacugauaacagugucaggucucuaccccuuggcaauuccagucacaaugaccuuaugguacauguggcaagugaaaacacaaagaucaggagcccugugggacguccccucaccugcugccgcucagaaagcuacacugacugagggaguauacaggaucaugcaaagaggguuguuugggaaaacccagguuggaguagggauacacacggaagguguguuucauacaauguggcauguaacaagaggaucaguaauuugccaugagagugggagacuggagccaucuugggcugacgucaggaacgacaugauaucauauggugggggauggaggcucggagacaaaugggauaaagaagaagauguucaaguucuagcuauagaaccaggaaaaaauccgaaacauguccaaacgaaacccggccucuucaaaacccuuacuggagaaauuggagcaguaacauuggacuucaaacccggaacauccgguucccccaucauuaacaggaaaggaaaagucaucggacucuacggaaaugggguaguuaccaaaucaggugauuacguuagugccauaacacaagcugaaagaauuggugagccagacuaugaaguggaugaggacauuuuccgaaagaaaagauuaaccauaauggauuuacaucccggagccggaaagacaaaaagaauccucccaucaauaguuagagaagccuuaaaaaggaggcugcgaaccuugauucuggcucccacgagagugguggcggccgaaauggaagaagcgcuacguggacugccaauccguuaucagaccccagcugugaaaucagaacacacaggaagagagaucguagaccucaugugucaugcaaccuuuacaacaagacuuuuaucaucgaccaggguuccaaauuacaaccucauagugauggaugaagcgcauuucacagacccuucuaguguugcagcuagaggauauaucucaaccaggguggaaaugggagaggcugcagcuaucuuuaugacugcaaccccuccuggaacgacagaucccuucccccagagcaacagcccaauagaagacaucgagagagaaaucccagaaaggucauggaacacaggguuugacuggauaacggacuaccaagggaaaacugugugguuuguucccagcauaaaagcuggaaaugacauugcaaauugcuugagaaaaucgggaaagaaggucauccaauugagcaggaaaaccuucgauacagaguauccaaaaacgaaacucacggacugggauuuugugguuaccacagacauaucugaaaugggggccaauuuuagagcugggagagugauagaccccaggagaugccucaagccaguuaucuuaacugaugggccagagagaguuauuuuagcuggucccauuccagugacuccagcaagcgcugcucagagaagagggcgaauagguaggaacccagcacaagaagaugaccaguaugucuucuccggagacccacuaaggaaugaugaagaucaugcccacuggacugaagcaaagaugcuucuugauaauaucuacaccccagaagggaucauuccaacacuguuugguccagaaagggaaaaaacccaagccauugauggagaguuccgccucagaggggagcaaaggaagaccuuuguagaauuaaugaggagaggagaccuuccgguguggcugagcuacaagguagcuucugcugguaucucuuacaaagaccgggaauggugcuuuacgggggaaaggaauaaccaaauucuggaagaaaacauggagguugaaauuuggacuagagagggagagaagaaaaaacucaggccaaaaugguuagaugcacguguuuacgcugaucccauggcuuugaaggauuucaaggaguuugccaguggaagaaagaguauaacccucgacaucuugacagaaauugccaguuugccaacguaccuuuccuccagggcuaagcucgcccuugacaacauagucaugcuccauacaacagaaagaggagggaaggccuaccaacacgcucugaacgaacucccagagucacuagaaacacucaugcuuguagcuuuauuaggagccaugacagcaggcaucuuccuauucuucaugcaaggaaaaggaauaggaaaauugucaauggguuugauagccauugcgguagcuaguggcuuacucuggguggcagaaauccagccccaauggauagcggccucaaucauauuggaguuuuuucucaugguguuguugguaccagaaccagaaaaacaaaggaccccacaagacaaucaauugaucuacgucauauugaccauucuuacuauuauugcucucguggcagccaaugagauggggcuaauugaaaaaacaaaaacggauuuuggguuuuaccaggugaaagcagaaaccaccauccuugauguggacuugagaccagcuucagcauggacgcucuaugcaguagcuaccacuaucuugacucccaugcugaggcacaccauagaaaacacgucugcaaacuuauccuuggcugccauugccaaccaagcagccguccugauggggcuuggaaaaggauggccgcuccacagaauggaccucggugugccgcuauuggcaaugggaugcuauucccaagugaacccaacaacuuuaacagcauccuuagucaugcuucugguccauuaugcaauaauagguccaggauugcaggccaaagccacaagagaggcucaaaaaaggacagcugcugggaucaugaagaaccccacgguggacgggauaacaguuauagaucuagaaccaauauccuaugacccaaaauuugagaagcagcuggggcaagucaugcuacuaguucugugcgcuggacagcuacucuugaugagaacaacaugggccuuuugugaagucuugacuuuggccacaggaccaaucuugaccuugugggaaggcaacccgggaagguuuuggaacacgacaauagccguguccacugccaacauuuucaggggaagcuacuuggcgggagcuggauuggccuuuucgcucauaaagaaugcacaaacccccaggaggggaacugggaccacaggagagacacugggagaaaaauggaagagacagcuaaacucgcuagauaggaaggaguuugaagaguacaaaagaaguggaauacuagaaguggacaggacugaagccaagucugcccuaaaagauggguccaaaaucaaguacgcaguguccagagguaccagcaagaucagauggauuguugaaagagggaugguaaagccaaaagggaaaguuguggaucuugguugcggaaggggaggauggucguacuauauggcgacacucaagaacgugaccgaggugaaaggguauacgaaaggagguccaggacaugaggaaccaauucccauggcuaccuauggcuggaacuuggucaaacuccauucagggguugacguguucuacaaacccacugagcaaguggacacuuugcucugugauauuggggagucauccucuaauccgacgauagaggaaggaagaacauuacgaguuuuaaagaugguggagccauggcucucuucaaaaccugaauucugcaucaaaguccucaaucccuacaugccaacagucauagaggagcuggagaaacugcagagacgauaugguggaagucuugucagaugcccgcuauccaggaauuccacucaugagauguauugggugucgggugugucaggaaacaucgugaguucugugaacacaacaucaaagauguuguugaacagauuuaccacaaggcacaggaaacccacuuaugagagggacgcagaccuuggagcaggaacgagaagugucuccaccgaaacagaaaaaccagacaugacaaucaucgggagaagacuccagcgauugcaagaagagcacaaagaaacuuggcacuaugaucaugaaaauccauacagaaccugggcguaucauggaagcuaugaagcucccucgacaggcucagcaucuuccauggugaacgggguaguuaaacugcugacaaaacccugggacgugguuccaauggugacucaguuggcuaugacagauacgacccccuuugggcaacagagaguguucaaggagaagguugacaccagaacaccacagccaaaacccgguacacgaguagucaugaccacgacagccaacuggcuguggacucuccucgggaggaagaaaaaucccagacugugcacaagggaagaauucaucucaaaaguuagguuaaacgcagccauaggcgcagucuuucaggaagaacagggauggacaucagccagugaggcagugaaugacagccgguuuugggaacugguugacaaagaaagggcucuacaccaggaagggaaaugugaaucaugugucuauaacaugaugggaaaacgugaaaaaaaauuaggagaauuuggcagagccaagggaagccgagcaaucugguacauguggcugggagcgcgguuucuggaauuugaagcccugggcuuuuugaaugaagaucacugguuuggcagggaaaacucauggaguggaguggaaggggaaggucugcauagguugggauacaucuuggaggacauagacaagaaggauggagauuugauauaugcugaugacacagcaggcugggacacaagaaucacugaagaugaccuucugaaugaagagcugaucacggaacagauggccccucaucauaaaauccuagcuaaagccauuuucaagcuaacuuaucaaaacaaagugguaaaaguccucagacccacaccgaaaggagcagugauggacauuauauccaggaaagaucaaagagguaguggacagguuggaacauaugguuugaacacauucaccaacauggaagugcaacucauccgccaaauggaagcugaaggagucauuacacgagaugacaugcauaacccaaaaggguugaaagaaagaguugagaaauggcugaaagaguguggugucgacagguuaaagaggauggcaauuaguggagacgauuguguggugaaaccucuagaugagagguucagcacuucccuccucuuuuugaacgacaugggaaaggugaggaaagacauuccgcaaugggaaccaucuaagggauggaaaaacuggcaagagguuccuuuuugcucccaccauuuucacaagaucuuuaugaaggauggccguucacuggucguuccauguagaaaccaggaugaacuaauagggagagccagaaucucgcaaggggcuggauggaguuuaagagaaacggccugucugggcaaagcuuacgcccagauguggucgcucauguacuuucauagaagggaccuacguuuagccuccauggcuauaugcucagcagucccaacggaaugguuuccaacaagcagaacaacauggucaauccacgcucaucaucaguggaugacuacugaagauaugcuaaaaguguggaacagaguguggauagaagacaacccuaacaugauugauaaaacuccaguucacucgugggaagauauaccuuaccuagggaaaagagaggauuugugguguggauccuugauuggacucucuucuagggccaccugggccaagaacauucacacagccauaacccaggucaggaaccugaucgggaaagaagaauauguggauuacaugccagccaugagaagauacagcgcucauuucgagagugaaggaguucuguaa

SEQ ID NO: 7847 - RNA, 9867 nt, Artificial Sequence
  derived and/or modified CDS sequence (wt) from DENV-4__JN638572__SS-prME
ucaacaauaacacugcugugcuugauucccacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugcgaggacaccgucacguauaaaugccccuuacuggucaauaccgaacccgaagacauugauugcuggugcaaucucacgucugccuggguuauguaugggacaugcacccaaaguggagaacgaaggcgagagaagcgcucaguagcucuaacaccacauucaggaaugggauuggaaacaagggcugaaacauggaugucaucggaaggagccuggaaacacgcccagaggguagagaguuggauacucagaaacccaggauucgcgcucuuggcaggguuuauggcauacaugaucgggcaaacaggaauccagcgaacagucuucuucauucuaaugauguuggucgccccaucuuacggaaugcgaugcguaggaguagggaacagagacuuuguagaaggagucucagguggagcaugggucgaucuggugcuagaacauggaggaugugucacuaccauggcccagggaaagccaacuuuggauuuugaacugaucaagacaacagccaaggaaguggcccuguuaagaaccuauugcauugaagcuuccauaucaaacauaaccacagcaacaagauguccaacgcaaggagagccuuaccucaaagaggaacaagaucaacaguacauuugccggagagacaugguagauagaggguggggcaacggcuguggcuuguuugggaagggaggaguugugacaugugcgaaguuuucaugcuuggggaagauaacgggcaacuuaguccaaauugagaaccuugaauacacagugguuguaacaguccacaauggagacacucacgcuguaggaaaugacacaucuaaccauggagugacagccacgauaacccccaggucaccaucgguugaaguuaaauuaccggaguacggagaauugacacuugacugugaaccuagguccggaauugacuuuaaugagaugauucugaugaaaaugaaaacgaaaacguggcucgugcacaagcaaugguuuuuggaucuaccucuaccauggacaacaggagcagacacgcuagaaguucacuggaaucacaaagagagaauggugacauuuaagguuccucaugccaagagacaggaugugacagugcuaggaucucaggaaggagccaugcauucagcccucgccggagccacagaaguggauuccggugauggaaaccauauguuugcaggacacuuaaaguguaaaguucgcauggaaaaguugaggaucaagggaaugucauacacgaugugcucaggaaaguucucaauugauaaagagauggcagaaacacagcauggaacaacagugguaaaggucaaguaugaggguacuggagcuccauguaaaguucccauagagauaagagaugugaacaaggaaaaagugguugggcgcauuaucucauccaccccuuuugcugagaauaccaacagugugaccaacauagaauuggaaccuccuuuuggggauagcuacauagugauaggugugggagacggugcauuaacacuccauugguucaggaaagggagcuccauuggcaagauguuugaguccacauacagaggugcaaagcgcauggccauucuaggugaaacagcuugggauuuugguuccguugguggacugcucacgucauuaggaaaggcuguacaccagguuuuuggcaguguguacacaacuauguuuggaggaguuucauggauggucagaauccuaaucgggcucuuaguguuguggauugguacgaauucaagaaacacuucaauggcuaugucgugcauagcuguuggaggaaucacccuguuucugggcuucacaguccaugcagacauggguuguguggugucauggagugggaaagaguugaaauguggaagcggaguuuuuguaauugacaacguacacacuuggacagaacaguacaaauuucaaccagagucuccagcgcgacuggcgucggcaauacugaaugcccacaaagaaggggucuguggaauuagaucaaccacgaggcuggaaaaugucauguggaaacaaauaacuaaugaguuaaacuauguucucugggaaggaggacaugaccucacuguaguggccggggaugugaaagggguguuguccaaaggcaagagagcacucgcaccuccagugaaugaccugaaauauucauggaagacaugggggaaagcaaagaucuuuacuccagaaacaagaaacagcacauuuuugguggacggaccagacaccuccgaaugccccaaugaacgaagagcauggaacuuucuugagguggaagacuauggauuuggcauguucacgaccaacauauggaugaaauuucgagaaggaaguucagaagugugugaccauaggcugaugucagcagcaaucaaagaccagaaagcugugcaugcugauaugggcuauuggauagagagcucaaaaaaccagaccuggcagauagagaaggcaucccucauagaagugaaaacaugucuguggcccaagacccacacauuguggagcaauggagugcuggaaagccagaugcucaucccaaaagcauaugcaggcccuaucucacagcacaacuaucgccagggcuaugccacgcagaccgcgggcccauggcacuugggcaaauuggaaauagacuuuggagaaugccccggaacaacagucacuguacaagaggauugugaccauagaggcccaucuuugaggaccaccacugcaucuggaaaauuggucacgcaguggugcugucgcuccugcacgaugccucccuuaagauuuuuaggagaggauggaugcugguaugggauggaaaucaggcccuugaaugaaaaagaagaaaacauggucaaaucacagguuucagccggacaggguacaucagagacuuuuucuauggggcuguugugccugacuuuguuuguggaagaaugcuugaggagaagagucaccaggaaacacaugauauugguuguggugaccacccuuugugccaucauuuuaggaggucuuacauggauggacuuacugcgugcccucaucaugcuaggggacaccaugucugguagaauggggggacaaauucaucuagccaucauggcaguguucaagaugucaccaggauacguguuggguauauuucugaggaaacucaccucaagagagacagcacugaugguaauaggaauggccaugacaacggugcuugcaauuccacaugaccuuauggaauuuauugauggaauaucauuaggguuaauuuuauuaaaaaugguaacacauuuugacaacacucaagugggaaccuuagcccuugccuuaaccuucauaaaaucaacaaugccauuggucauggcuuggaggaccauaauggcuguguuguucguggucacacucauuccucuauguaggacaagcugucuucaaaagcagucccauuggguggaaauaacagcacucauccugggagcccaggcucugccaguauaccuaaugacucucaugaaaggagccucaaaaagaucuuggccccuuaacgaggguauaauggcugugggcuuggucagucucuuaggaagcgcccuucuaaagaaugaugucccuuuagcuggcccaaugguggcaggagguuuacuucuggcagccuacgugaugagcggcagcucagcagaccugucacuagagaaggcugccaaugugcggugggaugagauggcagacauaacaggcucaagcccaaucauagaagugaagcaggaugaagauggcucuuucuccauacgggacgucgaggaaaccaacaugauuacccuccuggugaaacuggcacugauaacagugucaggucucuaccccuuggcaauuccagucacaaugaccuuaugguacauguggcaagugaaaacacaaagaucaggagcccugugggacguccccucaccugcugccgcucagaaagcuacacugacugagggaguauacaggaucaugcaaagaggguuguuugggaaaacccagguuggaguagggauacacacggaagguguguuucauacaauguggcauguaacaagaggaucaguaauuugccaugagagugggagacuggagccaucuugggcugacgucaggaacgacaugauaucauauggugggggauggaggcucggagacaaaugggauaaagaagaagauguucaaguucuagcuauagaaccaggaaaaaauccgaaacauguccaaacgaaacccggccucuucaaaacccuuacuggagaaauuggagcaguaacauuggacuucaaacccggaacauccgguucccccaucauuaacaggaaaggaaaagucaucggacucuacggaaaugggguaguuaccaagucaggugauuacguuagugccauaacacaagcugaaagaauuggugagccagacuaugaaguggaugaggacauuuuccgaaagaaaagauuaaccauaauggauuuacaucccggagccggaaagacaaaaagaauccucccaucaauaguuagagaagccuuaaaaaggaggcugcgaaccuugauucuggcucccacgagagugguggcggccgaaauggaagaagcgcuacguggacugccaauccguuaucagaccccagcugugaaaucagaacacacaggaagagagaucguagaccucaugugucaugcaaccuuuacaacaagacuuuuaucaucgaccaggguuccaaauuacaaccuuauagugauggaugaagcgcauuucacagacccuucuaguguugcagcuagaggauauaucucaaccaggguggaaaugggagaggcugcagcuaucuuuaugacugcaaccccuccugguacgacagaucccuucccccagagcaacagcccaauagaagacaucgagagagaaaucccagaaaggucauggaacacaggguuugacuggauaacggacuaccaagggaaaacugugugguuuguucccagcauaaaagcuggaaaugacauugcaaauugcuugagaaaaucgggaaagaaggucauccaauugagcaggaaaaccuucgauacagaguauccaaaaacgaaacucacggacugggauuuugugguuaccacagacauaucugaaaugggggccaauuuuagagcugggagagugauagaccccaggagaugccucaagccaguuaucuuaacugaugggccagagagaguuauuuuagcuggucccauuccagugacuccagcaagcgcugcucagagaagagggcgaauagguaggaacccagcacaagaagaugaccaguaugucuucuccggagacccacuaaggaaugaugaagaucaugcccacuggacugaagcaaagaugcuucuugauaauaucuacaccccagaagggaucauuccaacacuguuugguccagaaagggaaaaaacccaagccauugauggagaguuccgccucagaggggagcaaaggaagacuuuuguggaauuaaugaggagaggagaccuuccgguguggcugagcuacaagguagcuucugcugguaucucuuacaaagaccgggaauggugcuuuacgggggaaaggaauaaccaaauucuggaagaaaacauggagguugaaauuuggacuagagagggagagaagaaaaaacucaggccaaaaugguuagaugcacguguuuacgcugaucccauggcuuugaaggauuucaaggaguuugccaguggaagaaagaguauaacccucgacaucuugacagaaauugccaguuugccaacguaccuuuccuccagggcuaagcucgcccuugacaacauagucaugcuccauacaacagaaagaggagggaaggccuaccaacacgcucugaacgaacucccagagucacuagaaacacucaugcuuguagcuuuauuaggagccaugacagcaggcaucuuccuauucuucaugcaaggaaaaggaauaggaaaauugucaauggguuugauagccauugcgguagcuaguggcuuacucuggguggcagaaauccagccccaauggauagcggccucaaucauauuggaguucuuucucaugguguuguugguaccagaaccagaaaaacaaaggaccccacaagacaaucaauugaucuacgucauauugaccauucuuacuauuauugcucucguggcagccaaugagauggggcuaauugaaaaaacaaaaacggauuuuggguuuuaccaggugaaagcagaaaccaccauccuugauguggacuugagaccagcuucagcauggacgcucuaugcaguagcuaccacuaucuugacucccaugcugaggcacaccauagaaaacacgucugcaaacuuauccuuggcugccauugccaaccaagcagccguccugauggggcuuggaaaaggauggccgcuccacagaauggaccucggugugccgcuauuggcaaugggaugcuauucccaagugaacccaacaacuuuaacagcauccuuagucaugcuucugguccauuaugcaauaauagguccaggauuacaggcaaaagccacaagagaggcccagaaaaggacagcugcugggaucaugaagaaccccacgguggacgggauaacaguaauagaucuagaaccaauauccuaugacccaaaauuugaaaagcaauuagggcaagucaugcuacuaguacuguguguuggacaauuacuuuugaugagaacaacaugggcucucugcgaaguauugacuuuggccacaggaccaaucaugaccuugugggagggcaacccgggaagguuuuggaacacgaccauagcuguauccacagccaacauuuuuagaggaagcuacuuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaagagaaguggaauacuagaaguggauaggacugaagccaagucugcccuaagagauggaucuaaaaccaagcaugcgguguccagagggucuaguaagaucagauggauuguugaaagagggaugauaaagccaaaaggaaaggucguggaucuugguugcgggaggggaggaugguccuauuacauggcgacacuacagaacgugaccgaggugaaaggguauacgaaaggagguccaggacaugaggaaccgauucccauggcuaccuauggcuggaacuuggucaaacuccauucagggguugacguguucuacaaacccacugagcaaguggacacuuugcucugugauauuggggagucauccucuaauccgacgauagaggaaggaagaacauuacgaguuuuaaagaugguggagccauggcucucuucaaaaccugaauucugcaucaaaguccucaaucccuacaugccaacagucauagaggagcuggagaaacugcagagacgauaugguggaagucuugucagaugcccgcuauccaggaauuccacucaugagauguauugggugucgggugugucaggaaacaucgugaguucugugaacacaacaucaaagauguuguugaacagauuuaccacaaggcacaggaaacccacuuaugagagggacgcagaccuuggagcaggaacgagaagugucuccaccgaaacagaaaaaccagacaugacaaucaucgggagaagacuccagcgauugcaagaagagcacaaagaaacuuggcacuaugaucaugaaaauccauacagaaccugggcguaucauggaagcuaugaagcucccucgacaggcucagcaucuuccauggugaacgggguaguuaaacugcugacaaaacccugggacgugguuccaauggugacucaguuggcuaugacagauacgacccccuuugggcaacagagaguguucaaggagaagguugacaccagaacaccacagccaaaacccgguacacgaguagucaugaccacgacagccaacuggcuguggacucuccucgggaggaagaaaaaucccagacugugcacaagggaagaauucaucucaaaaguuaggucaaacgcagccauaggcgcagucuuucaggaagaacagggauggacaucagccagugaagcugugaaugacagccgguuuugggaacugguugacaaagaaagggcucuacaccaggaagggaaaugugaaucaugugucuauaacaugaugggaaaacgugaaaaaaaauuaggagaauuuggcagagccaagggaagccgagcaaucugguacauguggcugggagcgcgguuucuggaauuugaagcccugggcuuuuugaaugaagaucacugguuuggcagagaaaacucauggaguggaguggaaggggaaggucugcauagguugggauacaucuuggaggacauagacaagaaggauggagauuugauauaugcugaugacacagcaggcugggacacaagaaucacugaagaugaccuucugaaugaagagcugaucacggaacagauggccccucaucauaaaguccuagcuaaagccauuuucaaacuaacuuaucaaaacaaagugguaaaaguccucagacccacaccgaaaggagcagugauggacauuauauccaggaaagaucaaagagguaguggacagguuggaacauaugguuugaacacauucaccaacauggaagugcaacucauccgccaaauggaagcugaaggagucauuacacgagaugacaugcauaacccaaaaggguugaaagaaagaguugagaaauggcugaaagaguguggugucgacagguuaaagaggauggcaauuaguggagacgauuguguggugaaaccucuagaugagagguucagcacuucccuccucuuuuugaacgacaugggaaaggugaggaaagacauuccgcaaugggaaccauccaagggauggaaaaacuggcaagagguuccuuuuugcucccaccauuuucacaagaucuuuaugaaggauggccguucacuggucguuccauguagaaaccaggaugaacuaauagggagagccagaaucucgcaaggggcuggauggaguuuaagagaaacggccugucugggcaaagcuuacgcccagauguggucgcucauguacuuucauagaagggaccuacguuuagccuccauggcuauaugcucagcagucccaacagaaugguuuccaacaagcagaacaacauggucaauccacgcucaucaccaguggaugaccacugaagauaugcuuaaaguguggaacagaguguggauagaagacaaccccaacaugacugacaagacuccaguccauucgugggaagacauaccuuaccuagggaaaagagaggaucugugguguggaucccugauuggacuuuccuccagagccaccugggcgaagaacauucacacggccauaacccaggucaggaaucugaucggaaaagaggaauacauggauuacaugccagucaugaaaagauacagcgcuccuuccgagagugaaggaguucuguaa

SEQ ID NO: 7848 - RNA, 9867 nt, Artificial Sequence
  derived and/or modified CDS sequence (wt) from DENV-4__JX024757__SS-prME
ucaacaaugacauugcuguguuugauucccaccguaauggcguuccacuugucaacaagagacggcgaaccccucaugauaguggcaaaacacgaaagggggagaccucucuuguuuaagacaacagaaggaaucaacaaaugcacccucauugccauggaccuaggugaaaugugugaagacacugucacguauaaauguccucuacugguuaacaccgaaccugaagacauugauugcuggugcaaucucacguccacuugggucauguacgggacaugcacccagagcggagaacggaggcgagagaagcgcucaguagcccuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaacuguuuucuuuguccuaaugaugcuagucgccccaucuuacggaaugcgaugcguggggguagggaacagagacuuuguggaaggaguuucggguggggcaugggucgaccuggugcuagaacauggaggaugcguuacaaccauggcccagggaaaaccaaccuuggauuuugaacugaccaagacaacagcuaaggaaguggcucugcuaagaaccuauugcauugaagcuucaauaucaaacauaaccacggcaacaagauguccaacgcaaggagagccuuaucucaaagaggaacaagaccaacaguacauuugccggagagaugugguagauagaggguggggcaauggcuguggcuuguuuggaaaaggaggaguugugacaugugcgaaguuuuuaugcucggggaagauaacaggcaaucugguccaaauugaaaaccuugaauauacgguaguugugacaguccacaauggagacacccaugcaguaggaaaugacacauccaaucauggagugacagccacgauaacuccuaggucaccaucgguagaagucaaauugccggacuauggagaacuaacacucgauugugaacccaggucuggaauugauuucaaugagaugauccugaugaaaaugaaaaagaaaacguggcuugugcacaagcaaugguuuuuggaccuaccucuaccauggucagcaggagcagacacaucagaaguucauuggaauuacaaagagagaauggugacauucaaaguuccucaugccaagagacaggaugugacaguacuaggaucucaggagggagcuaugcauucugcccucgccggagccacagaaguggauucuggugauggaaaccacauguuugcaggacaucuuaagugcaagguucguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguccccauagagauaagagaugugaacaaggaaaaaguaguugggcgcaucaucucauccaccccuuuugcugagaauaccaacagcguaaccaacauagaauuagaacccccuuuuggggacagcuacauagugauagguguuggagacagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuugggaguguguauacaaccauguuuggaggggucucauggaugauuagaauccuaauuggguucuuaguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaauguuauguggaagcaaauaaccaacgagcuaaacuauguucucugggaaggaggacaugaccucacuguaguggcuggggacgugaaagggguguugaccaaaggcaagagagcacucacaccuccagugaaugauuugaaauauucauggaagacauggggaaaagcaaaaaucuuuaccccagaagcaagaaauagcacauuuuuaauagacggaccagacaccuccgaaugccccaauggacgaagagcauggaacuuuuuggagguagaagacuauggauuuggcauguuuacgaccaacauauggaugaaauuccgagaaggaagcucagaagugugugaccauagauuaaugucggcggcaaucaaagaucagaaagcugugcaugcugacauggguuauuggauagagagcucaaaaaaccagaccuggcaaauagagaaagcaucucuuauugaagugaaaacaugccuguggcccaaaacccacacgcuguggagcaauggagugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugucccggaacaacagucacaauucaggaggauugugaccauagaggcccaucuuugaggaccaccacugcaucuggaaaacuggucacgcagugguguugccgcuccugcacgaugccucccuuaagguucuugggagaagauggauguugguacgggauggagauuaggcccuugagugaaaaagaagagaacauggucaaaucacagguaacagccggacagggcacaucagaaacuuuuucuauggggcugcuaugccugaccuuguucguggaagaaugcuuaaggagaagagucacuaggaaauacaugauguugguugugguaaucaccuucugugcuaucauccuaggaggucucacauggauggacuuacuacgagcccuuaucauguuaggggacacuaugucuggcagaauaggaggacagauucaccuagccaucauggcaguguucaagaugucaccaggauauguguuggguguguuuuuaaggaaacuuacuucaagagagacagcgcuaaugguaauaggaauggccaugacaacuguguuuucaauuccacaugaccucauggaacucauugauggaauaucauugggguugauauuacuaagaauaguaacacacuuugauaacacccaagugggaaccuuagcccuuucccugacuuucauaagaucaacaacaccauuggucauggcuuggaggaccaucauggcuguguucuuugugguuacacucauuccuuugugcagaacaagcugucuucaaaaacagucccauuggguagaaauaacagcacuuaucuuaggggcccaggcuuugccaguguaccuaaugacccucaugaaaggagccucaagaagaucuuggccucuuaaugagggcauaauggcuguggguuuggugagccucuugggaagcgcccuccuaaagaaugauguuccuuuagccggcccaaugguggcaggaggcuugcuucuagcggcuuacguaaugaguggcagcucagcagaccugucacuagagaaggcugcuaaugugcaaugggaugaaauggcggacauaacuggcucaagcccaaucauagaagugaaacaggaugaagauggcucuuucuccauacgggacgucgaggaaaccaacaugauaacccucuuggugaaacuggcgcugauaacaguaucaggucuuuaccccuuggcaauuccagucacaauggcacuaugguauauuuggcaagugaaaacacaaagaucaggagcucugugggacguccccucacccgcugccacucagaaagccacacugucugaagggguguauaggaucaugcaaagaggguuguucgggaaaacucagguuggaguagggauacacauggaagguguauuucacacaauguggcauguaacaagaggaucagugaucugccaugagacagggagauuagagccaucuugggccgacgucaggaaugacaugauaucauacggugggggauggaggcucggagacaaaugggacaaagaagaagauguucagguccuagccauagaaccaggaaaaaaucccaaacauguccaaacgaaaccaggccuuuucaagacccuaacuggagaaaucggagcaguaacucuggauuucaaacccggaacgucuggcucucccaucauaaacaagaaagggaaaguuaucggacucuauggaaauggaguaguuaccaaaucaggugauuacguuagugccauaacgcaagccgaaagaauuggugagccagauuaugaaguggaugaggacauuuuucgaaagaaaagauuaacuauaauggacuuacaccccggagccggaaagacaaaaagaauucucccaucaauagucagagaagcuuugaaaaggaggcugcgcaccuugauuuuggcccccacgagagugguggcggccgagauggaagaggccuuacgcggacugccaauccguuaucagaccccggcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacauuucaaccaggguggaaaugggagaggcagcagcuaucuucaugacugcaaccccuccuggaucaauagaucccuucccccagagcaacagcccaauagaagacaucgagagggaaaucccagaaaggucauggaacacaggguucgacuggauaacagacuaccaaggaaaaacugugugguuuguucccagcauaaaagcuggaaaugacauugcaaauuguuugagaaagucgggaaagagagugauccaguugagcagaaaaaccuuugacacagaguauccaaagacgaaacucacggauugggauuuugugguuaccacagacauaucugaaaugggagcuaauuucagagccgggagagugauagaccccaggagaugccucaagccaguuauccuaacagaugggccagagagaguuauucuagcagguccaauuccaguaacuccagcaagugccgcucagagaagagggcgaauagguaggaauccagcacaagaagaugaccaauauguuuucuccggagacccacuaaagaaugaugaagaucaugcccacuggacagaagcaaagauguugcuugacaauaucuacacuccugaagggauaauuccaacauuguuugguccggaaagggaaaaaacccaagccauugauggagaguuucgccucagaggggaacaaaggaagacauuuguggaacugaugaggagaggggaccuuccgguguggcugagcuacaagguagcuucugccgguaucucuuauaaagaccgagaauggugcuuuacaggggaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugcuacuuugccaacuuaccuuuccucuaaggccaagcuagcccuugacaacauagucaugcuccacacaacagaaaaaggagggagggccuaccaacacgcccugaaugaacucccggagucacuggaaacacucaugcuuguagcccuacuaggugcuuugacagccgguaucuuccuguuuuucaugcaggggaaaggaauagggaaauugucaaugggucugauagccauagcuguggccaguggcuugcucuggguagcagaaauucagccccaguggauagcagcuucaaucauacuggaguuuuuucuuauggugcuguugauaccagaaccagaaaaacaaaggaccccacaagacaaucaacugaucuacguuauauugaccauucucaccauuauuggucucauagcagccaaugagauggggcugauugaaaaaacaaaaacggacuuuggguucuaccagguaaaaacagaaaccaccauucucgauguggauuugagaccagccucagcauggacacucuacgcaguggcuaccacuauucugacucccaugcugagacacaccauagagaacacgucugccaaccuaucuuuggcagccauugccaaccaagcagcuguccuaaugggacuugggaaaggauggccgcuccacagaauggaccucggcgugccgcugcuagcaaugggauguuauucucaagugaacccaacaacccugacagcaucccuagucaugcuuuuaguccauuaugccauaauagguccaggauuacaggcaaaagccacuagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuuaaugagaacaacaugggcucucugugaaguauugacucuggccacaggaccaaucaugaccuugugggagggcaacccgggaagauuuuggaacacaaccauagcaguauccacagccaauauuuuuagaggaagcuacuuggcgggagcuggacuagcuuuuucgcucauaaaaaaugcacaaaccccuaggaggggaacugggaccacaggagagacacugggagagaaguggaagagacagcugaacucauuagacagaaaagaguuugaagaguacaaaagaaguggaauacuagaaguggacaggacugaagccaagucugcccuaagagauggaucuaaaaucaagcacgcgguguccagagggucuaguaagaucagauggauuguugaaagaggaaugauaaaaccaaaaggaaaggucguagaucuugguugcgggaggggaggaugguccuauuacauggcgacacucaagaacgugacugaagugaaaggauauacuaaaggagguccaggacaugaagaaccaauccccauggcuacuuauggcuggaauuuggucaaacuccauucagggguugauguguucuacaaacccacugagcagguggacacccugcuaugugacauuggagagucauccucuaauccgacaauagaggaaggaagaacauugagagucuuaaagaugguggagccauggcucucuucaaaaccugaguucugcaucaaaguccucaaccccuacaugccgacaguuauagaagagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcgagaagagcacaaagaaaccuggcacuaugaccaggaaaacccauacagaaccugggcguaucaugggagcuaugaagcuccuucgacaggcucagcauccuccauggugaacgggguaguaaaacugcugacaaaacccugggaugugauuccaauggugacucaguuggccaugacagacacaaccccuuuugggcaacaaagaguguucaaggagaagguggauaccagaacaccacaaccaaaacccggcacacgaaugauuaugaccaugacagccaauugguuaugggcccuccucgggaagaagaaaagucccagacugugcacaagggaagaguucaucucaaaaguuaggucaaaugcagccauaggcgcagucuuucaggaagaacagggauggacaucagccagugaagcugugaaugacagccgguucugggaacugguugacaaagaaagggcucugcaccaggaaggaaaaugugaaucgugugucuauaacaugaugggaaaacgugagaaaaaauuaggagaguuugguagggccaagggaagccgagcaaucugguacauguggcugggggcgcgguuccuggaauuugaagcccuggguuuuuugaacgaagaucacugguuuagcagagaaaacucauggaguggaguggaaggggaaggucugcauagauugggauacaucuuggaggacauagacaagaaggauggagaccugauauaugcugacgacacagcaggcugggacacgagaaucacugaagaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagagguaguggacagguuggaacauaugguuuaaauacauucacuaacauggaaguccaacucauccgccaaauggaagcugaaggagucaucacacaagacgacaugcagaacccaagaggguugaaagaaagaguugagaaauggcugaaagaguguggcgucgacagguugaagaggauggcaaucaguggagaugauugcguggugaagcccauagaugagagguuuagcaccucccuccucuucuugaaugacaugggaaaggugaggaaagacaucccgcaaugggaaccauccaagggauggaaaaauuggcaagagguuccuuucugcucccaccauuuccacaagaucuucaugaaagauggccgcucacugguuguuccaugcagaaaccaggaugaacugauaggaagagccagaaucucgcagggggcuggauggagcuugagagaaacagccugucugggcaaagcuuaugcccagauguggucgcuuauguauuuccauagaagggaccugcgccuagccuccauggccauaugcucagcgguuccaacagaaugguuuccaacaagcagaacaacauggucaauccaugcucaucaccaguggaugaccacugaagauaugcuuaaaguguggaacagaguguggauagaagauaaccccaauaugacugacaagacuccaguccauucgugggaagacauaccuuaccuagggaaaagagaggaucugugguguggaucccugauuggacuuuccucuagagcaaccugggcgaagaacauucacacggccauaacccaggucaggaaucugaucggaaaagaggaauacguggauuacaugccagccaugaaaagauacagcgcuccuuucgagagugaaggaguucuguaa

SEQ ID NO: 7849 - RNA, 9867 nt, Artificial Sequence
  derived and/or modified CDS sequence (wt) from DENV-4__JF741967__SS-prME
ucaacaaugacauugcuguguuugauucccaccguaauggcguuucaccugucaacaagagauggcgaaccccucaugauaguggcaaaacacgaaagggggagaccucucuuguucaagacaacagaaggaaucaacaaaugcacccucauugccauggaccugggugaaaugugugaagacacugucacguauaaauguccucuacuggucaacaccgaaccugaagacauugauugcuggugcaaucucacguccaccugggucauguacgggacauguacccagagcggagaacggaggcgagaaaagcgcucaguagcuuuaacaccacauucaggaaugggauuggaaacaagagcugagacauggaugucaucggaaggggccuggaaacaugcucagagaguggaaagcuggauacucagaaacccaggauuugcgcuccuggcaggauuuauggcuuauaugauugggcaaacaggaauccagcgaacugucuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagcuaaagaaguggcucuguuaagaaccuauugcauugaagcuucgauaucgaacauaaccacggcaacaagauguccaacgcaaggagagccuuaucucaaagaggaacaagaccagcaguacauuugccggagagauguaguagauagaggguggggcaaugguuguggcuuguuuggaaaaggaggaguugugacaugugcgaaguuuuuaugcucggggaagauaacaggcaaucugguccaaauugaaaaccuugaauauacgguaguugugacaguccacaauggaaacacccaugcaguaggaaaugacacaucuaaucauggagugacagccacgauaacucccaggucaccaucgguagaagucaaauugccggacuauggagaacuaacacuugauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucaugccaagagacaggaugugacagugcuaggaucucaggagggagccaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaaugucauguggaagcaaauaaccaacgagcuaaacuauguucucugggaaggaggacaugaccucacaguaguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcaggcccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacugcaucuggaaaacuagucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugaccuuguucguggaagaaugcuuaaggagaagagucacuaggaaacacaugauauuggcugugguaaucaccuucugugcuaucauccuaggaggucucacauggauggacuuacuacgaguccuuaucauguuaggggacacuaugucugguagaauaggaggacagauucaccuagccaucauggcaguguucaagaugucaccaggauaugugcuggguguguuuuuaaggaaacuuacuucaagagagacagcguuaaugguaauaggaauggccaugacaacgguguuuucaauuccacaugaucucauggaacucauugauggaauaucauugggguugauauuacuaaaaauaguaacacacuuugauaacacccaagugggaacuuuagcccuuucccugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucucaaugagggcauaauggcugugggucuggugagccucuuaggaagcgcccucuuaaagaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccgaucauagaagugaagcaggaugaagauggcucuuucuccauacgggaagucgaggaaaccaacaugauaacccucuuggugaaacuagcgcugauaacaguaucaggucuuuaccccuuggcaauuccaguuacaauggcacuaugguauguuuggcaagugaaaacacaaagaucaggagcucugugggacguccccucacccgcugccacucauaaagccacacugucugaagggguguauaggauuaugcaaagaggguuguucgggaaaacucagguuggaguggggauacacauggaagguguauuccacacaguggggcacguaacaagaggaucagugaucugccaugaaacagggagauuagagccaucuuggggugacgucaggaaugacaugauaucauacggugggggauggaggcucggagacaagugggacaaagaagaagauguucagguccuagccauagaaccaggaaaaaauccuaaacauguccaaacgaaaccaggccuuuucaagaccuuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacaucuuccgaaagaaaagauuaaccauaauggacuuacaccccggagccgggaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacggugugguuuguucccagcauaaaagcuggaaaugacauugcaaauuguuugagaaagucgggaaagagagugauccaguugagcagaaaaaccuuugacacagaguauccaaagacgaaacucacggacugggauuuuguggucaccacagacauaucugaaaugggagccaauuucagagcugggagagugauagaccccaggagaugccucaagccaguuauccugacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacauuguuugguccggaaagggaaaaaacccaagcuauugauggagaguuucgccucagaggggaacaaaggaagacuuuuguggaauugaugaggagaggagaccuuccgguguggcugagcuacaagguagcuucugccgguauaucuuacaaagaccgagaauggugcuucacaggggaaaggaauaaccaaauuuuagaagaaaacauggagguugaaauauggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccauuauuggucuuauagcagccaaugagauggggcugauugaaaaaacaaaaacggacuuuggguucuaccagguaaaaccagaaaccaccauucuugauguggauuugagaccagccucagcguggacacucuaugcaguggccaccacuauucugacucccaugcugagacacaccauagagaacacgucugccaaccuaucucuagcagccauugccaaccaagcagcuguccuaaugggacuuggaaaaggauggccgcuccacaggauggaucucggugugccgcugcuagcaaugggaugcuauucucaagugaacccaacaaccuugacagcaucccuaguuaugcucuuaguucauuaugccauaauagguccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaaguacugacucuggccacaggaccagucaugaccuugugggagggcaacccgggaagguuuuggaacacaaccauagcuguauccacagcuaacauuuuuagaggaagcuacuuggcgggagcuggacuagcuuucucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaagagauggaaccaaaaucaaguaugcgguguccagagggucuaguaagaucagauggauuguugaaagaggaaugauaaaaccaaaaggaaaggucguagaucuugguugcgggaggggaggaugguccuauuacauggcgacgcucaagaacgugacugaagugaaaggauauacuaaaggagguccaggacacgaagaaccaauccccauggcuaccuauggcuggaauuuggucaaacuccauucaggaguugauguguucuacaaacccacagagcagguggacacccugcuuugugacauuggggagucauccucuaauccgacaauagaagaaggaagaacauugagagucuugaagaugguggagccauggcucucuucaaaaccugaguucugcauaaaaguccucaaccccuacaugccgacaguuauagaagagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacagucauugggagaaggcuucagagauugcgagaagagcacaaagaaaccuggcacuaugaccaggaaaacccauacagaaccugggcguaucauggaagcuaugaagcuccuucgacaggcucagcauccuccauggugaacgggguaguaaaacugcugacaaaaccuugggaugugauuccaauggugacucaguuggccaugacagacacaaccccuuuugggcaacaaagaguguucaaggagaagguggauaccagaacaccacaaccaaaacccggcacacggaugauuaugaccacgacagccaauugguugugggcccuccucgggaagaagaaaaguccuagacugugcacaagggaagaguucaucucaaaaguuaggucaaaugcagccauaggcgcagucuuccaggaagaacagggauggacaucagccagugaagcugugaaugacagccgguucugggaacugguugacaaagaaagggcucugcaccaggaaggaaaaugugaaucgugcgucuacaacaugaugggaaagcgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggggaaggucugcacagauugggauacaucuuggaggacauagacaagaaggauggagaccugauauaugcugacgacacagcaggcugggacacgaggaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaccaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagaguguggcgucgacagguugaagaggauggcaaucaguggagaugauugcguggugaagcccuuagaugagagguuuagcaccucccuccucuucuugaaugacaugggaaaggugaggaaagauaucccgcagugggaaccauccaagggauggaaaaacuggcaagagguuccuuuuugcucccaccauuuccacaagaucuucaugaaagauggccgcucacuaguuguuccaugcagaaaccaggaugaacugauaggaagagccagaaucucgcagggggcuggauggagcuugagagagacagccugucugggcaaagcuuacgcccaaauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaaccccaauaugacugacaagacuccaguccauucgugggaagacauaccuuaccuagggaaaagagaggaucuguggugcggaucccugauuggacuuucuuccagagccaccugggcgaagaauauucacacggcuauaacccaggucaggaaucugaucggaaaagaggaauauguggauuacaugccagccaugaaaagauacagcgcuccuuucgagagugaaggaguucuguaa

SEQ ID NO: 7850 - RNA, 9867 nt, Artificial Sequence
  derived and/or modified CDS sequence (wt) from DENV-4__JQ822247__SS-prME
ucaacaaugacauugcuguguuugauucccaccguaauggcguuucaccugucaacaagagauggcgaaccccucaugauaguggcaaaacacgaaagggggagaccucucuuguucaagacaacagaaggaaucaacaaaugcacccucauugccauggaccugggugaaaugugugaagacacugucacguauaaauguccucuacuggucaacaccgaaccugaagacauugauugcuggugcaaucucacguccaccugggucauguacgggacauguacccagagcggagaacggaggcgagaaaagcgcucaguagcuuuaacaccacauucaggaaugggauuggaaacaagagcugagacauggaugucaucggaaggggccuggaaacaugcucagagaguggaaagcuggauacucagaaacccaggauuugcgcuccuggcaggauuuauggcuuauaugauugggcaaacaggaauccagcgaacugucuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagcuaaagaaguggcucuguuaagaaccuauugcauugaagcuucgauaucgaacauaaccacggcaacaagauguccaacgcaaggagagccuuaucucaaagaggaacaagaccagcaguacauuugccggagagauguaguagauagaggguggggcaaugguuguggcuuguuuggaaaaggaggaguugugacaugugcgaaguuuuuaugcucggggaagauaacaggcaaucugguccaaauugaaaaccuugaauauacgguaguugugacaguccacaauggaaacacccaugcaguaggaaaugacacaucuaaucauggagugacagccacgauaacucccaggucaccaucgguagaagucaaauugccggacuauggagaacuaacacuugauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucaugccaagagacaggaugugacagugcuaggaucucaggagggagccaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaaugucauguggaagcaaauaaccaacgagcuaaacuauguucucugggaaggaggacaugaccucacaguaguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcaggcccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacugcaucuggaaaacuagucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugaccuuguucguggaagaaugcuuaaggagaagagucacuaggaaacacaugauauuggcugugguaaucaccuucugugcuaucauccuaggaggucucacauggauggacuuacuacgaguccuuaucauguuaggggacacuaugucugguagaauaggaggacagauucaccuagccaucauggcaguguucaagaugucaccaggauaugugcuggguguguuuuuaaggaaacuuacuucaagagagacagcguuaaugguaauaggaauggccaugacaacgguguuuucaauuccacaugaucucauggaacucauugauggaauaucauugggguugauauuacuaaaaauaguaacacacuuugauaacacccaagugggaacuuuagcccuuucccugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucucaaugagggcauaauggcugugggucuggugagccucuuaggaagcgcccucuuaaagaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccgaucauagaagugaagcaggaugaagauggcucuuucuccauacgggacgucgaggaaaccaacaugauaacccucuuggugaaacuagcgcugauaacaguaucaggucuuuaccccuuggcaauuccaguuacaauggcacuaugguauguuuggcaagugaaaacacaaagaucaggagcucugugggacguccccucacccgcugccacucagaaagccacacugucugaagggguguauaggauuaugcaaagaggguuguucgggaaaacucagguuggaguggggauacacauggaagguguauuccacacaauguggcacguaacaagaggaucagugaucugccaugagacagggagauuagagccaucuugggcugacgucaggaaugacaugauaucauacggugggggauggaggcucggagacaagugggacaaagaagaagauguucagguccuagccauagaaccaggaaaaaauccuaaacauguccaaacgaaaccaggccuuuucaagaccuuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacaucuuccgaaagaaaagauuaaccauaauggacuuacaccccggagccgggaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacggugugguuuguucccagcauaaaagcuggaaaugacauugcaaauuguuugagaaagucgggaaagagagugauccaguugagcagaaaaaccuuugacacagaguauccaaagacgaaacucacggacugggauuuuguggucaccacagacauaucugaaaugggagccaauuucagagcugggagagugauagaccccaggagaugccucaagccaguuauccugacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacauuguuugguccggaaagggaaaaaacccaagcuauugauggagaguuucgccucagaggggaacaaaggaagacuuuuguggaauugaugaggagaggagaccuuccgguguggcugagcuacaagguagcuucugccgguauaucuuacaaagaccgagaauggugcuucacaggggaaaggaauaaccaaauuuuagaagaaaacauggagguugaaauauggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccauuauuggucuuauagcagccaaugagauggggcugauugaaaaaacaaaaacggacuuuggguucuaccagguaaaaccagaaaccaccauucuugauguggauuugagaccagccucagcguggacacucuaugcaguggccaccacuauucugacucccaugcugagacacaccauagagaacacgucugccaaccuaucucuagcagccauugccaaccaagcagcuguccuaaugggacuuggaaaaggauggccgcuccacaggauggaucucggugugccgcugcuagcaaugggaugcuauucucaagugaacccaacaaccuugacagcaucccuaguuaugcucuuaguucauuaugccauaauagguccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaaguacugacucuggccacaggaccagucaugaccuugugggagggcaacccgggaagguuuuggaacacaaccauagcuguauccacagcuaacauuuuuagaggaagcuacuuggcgggagcuggacuagcuuucucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaagagauggaaccaaaaucaaguaugcgguguccagagggucuaguaagaucagauggauuguugaaagaggaaugauaaaaccaaaaggaaaggucguagaucuugguugcgggaggggaggaugguccuauuacauggcgacgcucaagaacgugacugaagugaaaggauauacuaaaggagguccaggacacgaagaaccaauccccauggcuaccuauggcuggaauuuggucaaacuccauucaggaguugauguguucuacaaacccacagagcagguggacacccugcuuugugacauuggggagucauccucuaauccgacaauagaagaaggaagaacauugagagucuugaagaugguggagccauggcucucuucaaaaccugaguucugcauaaaaguccucaaccccuacaugccgacaguuauagaagagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacagucauugggagaaggcuucagagauugcgagaagagcacaaagaaaccuggcacuaugaccaggaaaacccauacagaaccugggcguaucauggaagcuaugaagcuccuucgacaggcucagcauccuccauggugaacgggguaguaaaacugcugacaaaaccuugggaugugauuccaauggugacucaguuggccaugacagacacaaccccuuuugggcaacaaagaguguucaaggagaagguggauaccagaacaccacaaccaaaacccggcacacggaugauuaugaccacgacagccaauugguugugggcccuccucgggaagaagaaaaguccuagacugugcacaagggaagaguucaucucaaaaguuaggucaaaugcagccauaggcgcagucuuccaggaagaacagggauggacaucagccagugaagcugugaaugacagccgguucugggaacugguugacaaagaaagggcucugcaccaggaaggaaaaugugaaucgugcgucuacaacaugaugggaaagcgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggggaaggucugcacagauugggauacaucuuggaggacauagacaagaaggauggagaccugauauaugcugacgacacagcaggcugggacacgaggaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaccaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagaguguggcgucgacagguugaagaggauggcaaucaguggagaugauugcguggugaagcccuuagaugagagguuuagcaccucccuccucuucuugaaugacaugggaaaggugaggaaagauaucccgcagugggaaccauccaagggauggaaaaacuggcaagagguuccuuuuugcucccaccauuuccacaagaucuucaugaaagauggccgcucacuaguuguuccaugcagaaaccaggaugaacugauaggaagagccagaaucucgcagggggcuggauggagcuugagagagacagccugucugggcaaagcuuacgcccaaauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaaccccaauaugacugacaagacuccaguccauucgugggaagacauaccuuaccuagggaaaagagaggaucuguggugcggaucccugauuggacuuucuuccagagccaccugggcgaagaauauucacacggcuauaacccaggucaggaaucugaucggaaaagaggaauauguggauuacaugccagccaugaaaagauacagcgcuccuuucgagagugaaggaguucuguaa

SEQ ID NO: 7851 - RNA, 9867 nt, Artificial Sequence
  derived and/or modified CDS sequence (wt) from DENV-4__JF262783__SS-prME
ucaacaguaacauugcugugcuugauucccaccguaauggcguuucaccugucaacaagagauggcgaaccccuuaugauaguggcaaaacaugaaagggggagaccucucuuguuuaagacaacagaaggaaucaacaaaugcacucuuauugccauggacuugggugaaaugugugaggacacugucauguacaaaugcccucuacuggucaauacugaaccugaagacauugacugcuggugcaaucucacgucuaccugggucauguaugggacauguacccagagcggagaacggagacgagagaagcgcucaguagcuuugacaccacauucaggaaugggauuggaaacaagggcugagacauggaugucaucggaaggagcuuggaagcaugcccaaagaguagagagcuggauacucagaaacccaggauucgcgcucuuggcaggauucauggcuuacaugauugggcaaacaggaauccagcgaacugucuucuuuguucuaaugaugcuggucgcuccauccuacggaaugcgaugcgugggaguggggaacagagacuuuguggaaggagucucagguggagcaugggucgaucugguacuagaacauggaggaugcgucacaaccauggcccagggaaaaccaacccuggauuuugaacugaucaagacaacagccaaggaagugacucuguuaagaaccuauugcauugaggcuucgauaucaaacauaacuacggcaacaagauguccaacgcaaggagagcccuaucucaaagaggaacaagaucaacaguauauuugccggagagaugugguagacagaggguggggcaauggcuguggcuuguuuggaaaaggaggaguugugacaugugcgaaguuuuuaugcucgggaaagauaacaggcaauuugguucaaauugagaaccuugaauacacagugguugugacaguccacaacggagacacccauguaguaggaaaagacacauccaaccacggagugacagcuacgauaacuccuaggucaccaucaguagaggucaaauuaccggacuauggagaauuaacacuugauugugaacccagguccggaauugacuucaaugagaugauucuaaugaaaaugaaaaagaaaacguggcuugugcacaagcaaugguuuuuggaucuaccucuaccauggacagcaggggcagacacaucagaaguucaguggaauuacaaagagagaauggugacauucaaggucccucaugccaagagacaggaugugacagugcuagggucucaggaaggagcuaugcauucugcccucaccggagcuacagaaguggauuccggugauggaaaccauauguuugcaggacaucuaaaguguaaaguucguauggagaaauugagaaucaaaggaaugucauauacgaugugcucaggaaaguucucaauugacaaagagauggcagaaacacagcaugggacgacaguagugaaagucaaguacgaaggugcuggagcuccauguaaaguccccauagaaauaagagaugugaacaaggaaaaagugguugggcgcaucaucucauccaccccuuuugcugagaacaccaacaguguaaccaacauagaguuagaaccccccuuuggggacaguuacauaguaauagguguuggagacagugcauuaacucuucauugguucaggaaagggaguuccauuggcaagauguuugagucuacauauagaggugcaaagcgaauggccauucuaggugaaacagcuugggauuuugguucaguugguggacuauucacaucauugggaaaggcugugcaccagguuuuugguagcguguacacaacuauguuuggaggagucucauggaugguuagaauccuaaucgggcuccuaguguuguggauugguacgaauucaagaaacacuucaauggcaaugacgugcauagcuauuggaggaaucacucuguuucuggguuucacaguucacgcagacauggguugugcggugucauggagugggaaagaauugaaauguggaagcggaauuuuuguaauugacaacgugcacaccuggacagaacaguacaaauuucaaccagaguccccagcaagacuagcgucugcaauauugaaugcucacaaagauggggucuguggaauuagaucaaccacgaggcuggaaaaugucauguggaagcaaauaaccaacgagcuaaacuauguucucugggaaggaggacaugaccucacuguaguggccggggaugugaaagggguguuaaccaaaggcaagagagcacucacaccuccagugaaugauuugaaauauucauggaagacauggggaaaagcaaaaaucuucacuccagaagcaagaaauagcacauuuuugauagacggaccagacaccuccgaaugccccaaugaacgaagagcauggaacuuucuugagguagaagacuaugguuuuggcauguuugcgaccaacauauggaugaaauuucgagaaggaaguucagaggugugugaucacagguuaaugucggcggcaaucaaagaucagaaagcugugcaugcugacaugggcuauuggauagagagcucaaaaaaccagaccuggcagauagagaaagcaucccucauugaagugaaaacaugucuguggcccaagacccacacauuguggagcaaugaaguguuggaaagccaaaugcucauuccaaaagcauaugcaggcccuuuuucacagcauaauuaucgccagggcuaugccacgcagaccauaggcccauggcacuugggcaaauuggagauagacuuuggagaaugccccggaacaacagucacaauucaggaggauuguaaccauagagguccaucuuugaggaccacuacugcaucuggaaaauuggucacgcaguggugcugccgcuccugcacgaugccucccuuaagguuuuugggagaggauggguguugguaugggauggaaauuaggccuuuaagugaaaaagaagagaacauggucaaaucacagguaucggccggacaggguacaucagaaacuuuuucuauggggcuguuaugccugaccuuguuuguggaagaaugcuugaggagaagagucacuaggaaacacaugauauugguuguggugaccacccuuugugccaucauccuaggaggucucacauggauggaccuacuacgagcucuuaucauguuaggggacaccaugucugguaggaugggaggacagauucaccuaaccauuauggcaguguucaagaugucaccaggauaugugcuggguguguuuuuaaggaaacucacuucgagagagacagcacuaauaguaauaggaauggccaugacaacagugcuuucaauuccacaugaccucauggaauucaucgauggaauaucacugggguuaaucuugcuaaaaaugguagcucauuuugauaacacccaagugggaaccuuagcccuuuccuugacuuucauaagaucaacaaugccauuggucauggccuggaggaccaucauggcuguguuguuuguggucacacucauuccucuauguaggacaagcugucuucaaaagcagucccauuggguagaaauaacagcacucauccuaggagcucaggcucugccaguguaccuaaugacccucaugaaaggagccucaaaaagauccuggccucuuaacgagggcauaauggcuguggguuugguuagucucuuaggaagcgcccuuuuaaagaaugaugucccucuggcuggcccaaugguagcgggaggcuuacuucuggcagccuacgugaugagugguagcucagcagaucugucacuagaaaaggccgccaaugugcagugggaugagauggcagacauaacaggcucaagcccaaucauagaagugaagcaggaugaagauggcuccuucuccauacgggaugucgaggaaaccaauaugauaacccuuuuggugaaacuggcacugauaacagugucaggucucuaccccuuggcaauuccagucacaauggccuuaugguacauguggcaggugaaaacgcaaagaucaggggcccuaugggacguccccucacccgcugcagcucagaaagccacacugacugaaggaguguacaggaucaugcagagaggguuguuugggaaaacucagguugggguggggauacacauggaagguguauuucacacaauguggcauguaacaagaggaucagugaucugccaugagacugggagauuagagccgucuugggcugacgucaggaacgacaugauaucauacggugggggauggagacucggagacaaaugggacaaagaagaagauguucagguucuagccauagaaccgggaaaaaacccgaaacauguccaaacgaaacccggccuuuucaagacccuaacuggagaaauuggagcaguaacauuggauuucaaacccggaacgucuggcucucccaucauuaacaagaaaggaagaguuaucggacucuauggaaauggaauaguuaccaaaucaggugauuaugucagugccauaacgcaagccgaaagaauuggugagccagauuaugaaguggaugaggacauuuuccggaagaaaagauugacuguaauggauuuacaccccggagccggaaagacaaaaagaauucucccaucaauagucagagaagccuuaaaaaggaggcuacgaaccuugauuuuggcccccacgagagugguggcggccgagauggaagaggcccuucguggacugccaauccguuaucagaccccagcugugaaaucagaacacacaggaagagaaauuguagaccucaugugccaugcaaccuucacaacaagacuuuugucaucaaccagaguuccaaauuacaaccucauagugauggaugaagcacauuucacagacccuucuagugucgcggccagaggauacaucucaaccaggguggaaaugggagaggcagcagcuaucuuuaugacugccaccccuccaggagcgacagaccccuucccccagagcaacagcccaauagaagauaucgagagggaaauuccugaaaggucauggaauacaggguucgacuggauaacagacuaccaagggaaaacugugugguuuguucccaguauaaaagcuggaaaugacauugcaaauugcuugagaaagucgggaaagaaggugauccaguuaaguaggaaaaccuuugacacagaguacccaaaaacgaaacucacagacugggauuuuguggucaccacagacauaucugaaaugggggccaacuuuagagcuaggagagugauagacccuaggagaugccucaagccaguuauccuaacagauggaccagagagagucauuuuagcaggucccauuccagugacuccagcaagugcugcucagagaagagggcgaauagguaggaacccagcacaagaagacgaccaauacgucuucuccggagacccacuaaaaaaugaugaagaucaugcccacuggacagaagcaaagaugcugcuugacaauaucuauaccccggaaggaaucauuccaacauuguuugguccagaaagggaaaaaauccaagcuauugauggagaguuccgccucagaggggaacagaggaaaacuuuuguggaacuaaugaggagaggagaccuuccgguguggcugagcuauaagguggcuucugcuggcauuucuuacaaagaccgggaauggugcuucacaggggaaagaaauaaccaaauuuuagaagaaaauauggagguugaaauuuggacuagagagggagaaaagaaaaaacuaaggccaaaaugguuagaugcacguguuuaugcugaccccauggcuuugaaggauuucaaggaguuugccagcggaagaaagagcauaacccuugacauccuaacagagauugccaguuugccaacuuaucuuuccucuagggcuaagcucgcucuugacaacauagucaugcuccacacaacagagagaggagggagggccuaccaacacgcccugaacgaacucccggagucacuggaaacacucaugcuaguagccuuacuaggugcuaugacagcaggcaucuuccuguuuuucaugcaaggaaaaggaauagggaaauugucaauggguuugauggccauugcgguagcuaguggcuugcucuggguagcagaaauucagccccaguggauagcggccucaaucauacuggaguuuuuucuuauggcacuguugauaccagaaccagaaaaacaaaggaccccacaagacaaucaauugaucuaugucauacugaccauucucaccauuauuggucucauagcagccaacgagauggggcugauugaaaaaacaaaaacggauuuuggguuuuaccagguaaaaacagaaaccaccauccucgauguggacuugagaccagcuucagcauggacgcucuaugcgguagccaccacuauuuugacuccuaugcugagacacaccauagaaaacacgucugcuaacuuaucucuagcggccauugccaaccaagcagcuguccuaauggggcuuggaaaaggauggccacuccacagaauggaccuuggugugccgcuguuggcaaugggauguuacucucaagugaacccaacaacucugacagcauccuuagucaugcuuucaguccauuaugcaauaauagguccaggauugcaggcaaaagccacaagagaggcucagaaaaggacagcugcugggaucaugaagaaccccacgguggacgggauaacaguaauagacuuagaaccaauauccuaugacccaaaauuugaaaagcaauuagggcaagucaugcuacuagcauugugugcuggacaacuacucuugaugagaacaacaugggcuuucugugaagucuugacuuuggccacaggaccaaucuugaccuugugggagggcaacccgggaagguuuuggaacacgaccauagccguauccacugccaauauuuucaggggaagcuacuuggcgggagcuggacuggcuuuuucgcucauaaagaacgcacaaacccccaggaggggaacugggaccacaggagagacacugggagagaaguggaagagacagcuaaacucauuagacaggaaggaguuugaagaguacaagagaaguggaauacuagaaguggacaggacugaagccaagucugccuuaaaagauggguccaaaaucaagcaugcaguguccagaggguccagcaagaucagauggauuguugaaagagggaugguaaaaccaaaaggaaaaguuguggaccuuggcugcgggagaggaggauggucguauuacauggcgacacuuaagaacgugacugaggugaaaggguauacaaaaggagguccaggacaugaagaaccgauucccauggcuaccuauggcuggaauuuggucaaacuccauucaggaguugacguguucuauaaacccacugagcaaguggacacccugcucugugauauuggggagucaucuuccaauccgacgauagaagaaggaagaacauugagaguuuugaagaugguggaaccauggcucucuucaaaaccugaauucugcaucaaaguccuuaaccccuacaugccaacagucauagaagagcuggagaaacuacagagaaaacaugguggaagucuugucagaugcccgcuauccaggaauucuacucaugagauguacugggugucaggugcgucgggaaacauugugagcucugugaacacaacaucaaagauguuguuaaacagguuuaccacaaggcacagaaaaccuacuuaugagaaggauguaaaccuuggagcagggacgagaagugucuccacugaaacagaaaaaccagacaugacaaucaucgggagaaggcuucagcgguugcgagaagagcacaaagaaacuuggcacuacgaucaggaaaacccauacaggaccugggcguaucacggaagcuaugaagcuccuucgacaggcucagcauccuccauggugaacgggguaguaaaacugcugacaaagccuugggacguaauuccaauggugacccaguuagccaugacagacacaaccccuuuugggcaacagagaguguucaaagagaagguagauaccagaacaccacaaccaaaacccgguacacgaaugguuaugaccacaacagccaauuggcugugggcccuccuugggaagaagaaaagucccagacugugcacaagggaagaguucaucucaaaaguuaggucaaacgcagccauaggcgcaguuuuucaagaagaacagggauggacaucagccagugaagcugugaaugacagccgguuuugggaacugguugacaaagaaagggcucugcaccaggaagggaaaugugaaucgugugucuauaacaugaugggaaaacgugagaaaaagcuaggagaguuugguagagccaagggaagccgagcaaucugguacauguggcugggagcgcgguuucuggaauuugaagcccuggguuuuuugaaugaagaucacugguuuggcagagaaaauucauggagugggguggaaggggaagguuugcauagauugggauauauccuggaggacauagacaagaaggauggagaccugauauaugcugaugacacagcagguugggacacaagaaucacugaagaugaccuucugaaugaagaacugaucacggaacagauggcuccucaucauaggauccuagccaaagccauuuucaaauuaacuuaucaaaacaaaguggugaaaguccucagacccacaccgaaaggagcggugauggauaucauauccaggaaagaccaaagagguaguggacagguuggaacauaugguuugaacacauucaccaacauggaaguacaacucauccgccaaauggaagcugaaggagucauuacacaagaugacaugcagaacccaaaaggguugaaagaaagaguugagaaauggcugaaggaguguggugucgacagguuaaagaggauggcaaucaguggagacgauuguguggugaagccccuggacgagagguucagcacuucccuccucuuuuugaacgacaugggaaaggugaggaaagacauuccgcagugggaaccaucuaagggauggaaaaacuggcaagagguucccuuuugcucccaccacuuucacaagauuuucaugaaggauggccgcucacuaguuguuccauguagaaaccaggaugagcugauagggagagccagaaucucacagggggcuggauggagucuaagagaaacagccugucugggcaaagcuuacgcccagauguggucgcucauguacuuucacagaagggaccugcguuuagccuccauggccauaugcucagcaguuccaacggaaugguucccaacaagcagaacaacauggucaauccacgcccaucaccaguggaugaccacugaagauaugcucaaaguguggaacagaguguggauagaagacaacccuaacaugacugacaagaccccaguccauucgugggaagacauaccuuaccuagggaaaagagaggacuugugguguggauccuugauuggacucucuuccagagccaccugggcaaagaacauucacacagccauaacccaagucaggaaccugaucgggaaagaggaguauguagauuacaugccagucaugaaaagauacagcgcucccuucgagagugaaggaguucuguaa

SEQ ID NO: 7852 - RNA, 9867 nt, Artificial Sequence
  derived and/or modified CDS sequence (wt) from DENV-4__KU513441__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcacucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaagagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuauggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcucugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacuaccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaauccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacggaauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcugaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguucggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggacggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7853 - RNA, 9867 nt, Artificial Sequence
  derived and/or modified CDS sequence (wt) from DENV-4__KC762694__SS-prME
ucaacaaugacauugcuguguuugauucccaccguaauggcguuucaccugucaacaagagauggcgaaccccucaugauaguggcaaaacacgaaagggggagaccucucuuguuuaagacaacagaaggaaucaacaaaugcacccucauugccauggaccugggugaaaugugugaagacacugucacguauaaauguccucuacuggucaacaccgaaccugaagacauugauugcuggugcaaucucacguccaccugggucauguacgggacauguacccagagcggagaacggaggcgagaaaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaacuguuuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagcuaaggaaguggcucuguuaagaaccuauugcauugaagcuucgauaucaaacauaaccacggcaacaagauguccaacgcaaggagagccuuaucucaaagaggaacaagaccagcaguacauuugccggagagaugugguagauagaggguggggcaauggcuguggcuuguuuggaaaaggaggaguugugacaugugcgaaguuuuuaugcucggggaagauaacaggcaaucugguccaaauugaaaaccuugaauauacgguaguugugacaguccacaauggagacacccaugcaguaggaaaugacacauccaaucauggagugacagccacgauaacucccaggucaccaucgguagaagucaaauugccggacuauggagaacuaacacucgauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucaugccaagagacaggaugugacagugcuaggaucucaggagggagcuaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccucgaggcuggaaaaugucauguggaagcaaauaaccaacgagcuaaacuauguucucugggaaggaggacaugaccucacuguaguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucggaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcaggcccuuuuucacagcauaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacagcaucuggaaaacuggucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugacccuguucguggaagaaugcuuaaggagaagagucacuaggaaacacaugauauugguugugguaaucaccuucugugcuaucauccuaggaggucucacauggauggacuuacuacgagcccuuaucauguuaggggacaccaugucugguagaauaggaggacagauucaccuagccaucauggcaguguucaagaugucaccaggauaugugcuggguguguuuuuaaggaaacuuacuucaagagagacagcgcuaaugguaauaggaauggccaugacaacgguguuuucaauuccacaugaucucauggaacucauugauggaauaucauugggguugauauuacuaaaaauaguaacacacuuugauaacacccaagugggaacuuuagcccuuucccugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccucuuaaagaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccgaucauagaagugaagcaggaugaagauggcucuuucuccauacgggacgucgaggaaaccaacaugauaacccucuuggugaaacuggcgcugauaacaguaucaggucuuuaccccuuggcaauuccaguuacaauggcacuaugguauguuuggcaagugaaaacacaaagaucaggagcucugugggacguccccucacccgcugccacucagaaagccacacugucugaagggguguauaggaucaugcaaagaggguuguucgggaaaacucagguuggaguggggauacacauggaagguguauuccacacaauguggcacguaacaagaggaucagugaucugccaugagacagggagauuagagccaucuugggcugacgucaggaaugacaugauaucauacggugggggauggaggcucggagacaagugggacaaagaagaagauguucagguccuagccauagaaccaggaaaaaauccuaaacauguccaaacgaaaccaggccuuuucaagacccuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacaucuuucgaaagaaaagauuaaccauaauggacuuacaccccggagccggaaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacugugugguuuguucccagcauaaaagcuggaaaugacauugcaaauuguuugagaaagucgggaaagagagugauccaguugagcagaaaaaccuuugacacagaguauccaaagacgaaacucacggacugggauuuuguggucaccacagacauaucugaaaugggagccaauuucagagcugggagagugauagaccccaggagaugccucaagccaguuauccugacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacauuguuugguccggaaagggaaaaaacccaagcuauugauggagaguuucgccucagaggggaacaaaggaagacuuuuguggaauugaugaggagaggagaccuuccgguguggcugagcuauaagguagcuucugccgguauaucuuacaaagaccgagaauggugcuucacaggggaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccaucauuggucuuauagcagccaaugagauggggcugauugaaaaaacaaaaacggacuuuggguucuaccagguaaaaacagaaaccaccauucuugauguggauuugagaccagccucagcguggacacucuaugcaguggccaccacuauucugacucccaugcugagacacaccauagagaacacgucugccaaccuaucucuagcagccauugccaaccaagcagcuguccuaaugggacuuggaaaaggauggccgcuccacaggauggaccucggugugccgcugcuagcaaugggauguuauucucaagugaacccaacaaccuugacagcaucccuaguuaugcuuuuaguucauuaugccauaauagguccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaagugcugacucuggccacaggaccagucaugaccuugugggagggcaacccgggaagguuuuggaacacaaccauagcuguauccacagcuaacauuuuuagaggaagcuacuuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaagagauggauccaaaaucaaguaugcgguguccagagggucuaguaagaucagauggauuguugaaagaggaaugauaaaaccaaaaggaaaggucguagaucuugguugcgggaggggaggaugguccuauuacauggcgacacucaagaacgugacugaagugaaaggauauacuaaaggagguccaggacaugaagaaccaauccccauggcuacuuauggcuggaauuuggucaaacuccauucaggaguugauguguucuacaaacccacagagcagguggacacccugcuuugugacauuggggagucauccucuaauccgacaauagaggaaggaagaacauugagagucuugaagaugguggagccauggcucucuucaaaaccugaguucugcaucaaaguccucaaucccuacaugccgacaguuauagaggagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcgagaagagcacaaagaaaccuggcacuaugaccaggaaaacccauacagaaccugggcguaucauggaagcuaugaagccccuucgacaggcucagcauccuccauggugaacgggguaguaaaacugcugacaaaaccuugggaugugauuccaauggugacucaguuggccaugacagacacaaccccuuuugggcaacaaagaguauucaaggagaagguggauaccagaacaccacaaccaaaacccggcacacggaugauuaugaccacgacagccaauugguugugggcccuccucgggaagaagaaaaguccuagacugugcacaagggaagaguucaucucaaaaguuaggucaaaugcagccauaggcgcagucuuucaggaagaacagggauggacaucagccagugaggcugugaaugacagccgguucugggaacugguugacaaagaaagggcucugcaccaggaaggaaaaugugaaucgugugucuacaacaugaugggaaagcgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggggaaggucuacauagauugggauacaucuuggaggacauagacaagaaggauggagaccugauauaugcugacgacacagcaggcugggacacgagaaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaucaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagaguguggcgucgacagguugaagagaauggcaaucaguggagaugauugcguggugaagcccuuagaugagagguuuagcaccucccuccucuucuugaaugauaugggaaaggugaggaaagauaucccgcagugggaaccauccaagggauggaaaaacuggcaagagguuccuuuuugcucccaccauuuccacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaacccuaauaugacugacaagacuccaguccauucgugggaagacauaccuuaccuagggaaaagagaggaucuguggugcggaucccugauuggacuuucuuccagagccaccugggcgaagaacauucacacggccauaacccaggucaggaaucugaucggaaaagaggaauacguggauuacaugccagccaugaaaagauacagcgcuccuuucgagagugaaggaguucuguaa

SEQ ID NO: 7854 - RNA, 9867 nt, Artificial Sequence
  derived and/or modified CDS sequence (wt) from DENV-4__KC762695__SS-prME
ucaacaaugacauugcuguguuugauucccacugcaauggcguuucaccugucaacaagagacggcgaaccccucaugauaguggcaaaacacgaaagggggagaccucucuuguuuaagacaacagaaggaaucaacaaaugcacccucauagccauggaccugggugaaaugugugaagacacugucacguauaaauguccucuauuaguuaacaccgaaccugaagacauugauuccuggugcaaucucacguccaccuggguuauguacgggacaugcacccagagcggagaacggaggcgagaaaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuucuggcaggauucauggcuuacaugauugggcaaacaggaauccagcgaacuguuuucuuuguccuaaugaugcuaguugccccauccuacggaaugcgaugcguagggguagggaacagagacuuuguggaaggagucucggguggggcaugggucgacuuggugcuagaacauggaggaugugucacaaccauggcccagggaaaaccaaccuuggauuuugaacugaccaagacaacagcuaaggaaguagcucuguuaagaaccuauugcauugaagcuucgauaucgaacauaaccacggcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauauacgguaguugugacaguccacaauggagacacccaugcaguaggaaaugacacauccaaucauggagugacagcuacgauaacucccaggucaccaucgguagaaguuaaauugccggacuauggagaacuaacacucgauugugaacccagguccggaauugauuucaaugagaugauccugaugaaaaugaaaaagaaaacguggcuugugcacaagcaaugguucuuggaccuaccucuaccguggacagcaggagcagacacaucagaaguccauuggaauuacaaagagagaauggugacauucaaaguuccucaugccaagagacaggaugugacagugcuaggaucucaggagggagcuaugcauucugcccucgccggagccacagaaguggauucugguaauggaaaucacauguuugcaggacaucucaagugcaaaguucguauggagaaauugagaauuaagggaaugucauacacgauguguucaggaaaguucucaauugacaaagagauggcagaaacacagcaugggacaacaguggugaaagucaaguaugaaggcgcuggagcuccauguaaaguucccauagagauaagagaugugaacaaggaaaaaguaguugggcgcaucaucucauccaccccuuuugccgagaacaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuugguucuguugguggacuguuuacgucacugggaaaggcuauacaccaaguuuuuggaaguguguauacaaccauguuuggaggggucucauggaugaucagaauccuaauugggcucuuaguauuguggauuggcacgaauucaagaaacacuucaauggcaaugacgugcauagcuguuggaggaaucacucuguuucuagguuucacaguucaagcagacauggguuguguggugucauggaaugggaaggaacuaaaauguggaagcggaauuuuugugguugacaaugugcauacuuggacagaacaguacaaauuccaaccagaguccccagcgaggcuagcuucugcaauauugaaugcccacaaagauggggucuguggaaucagaucaaccacgaggcuggaaaauguuauguggaagcaaauaaccaacgagcuaaacuauguucucugggaaggaggacaugaccucacuguaguggccggggaugugaaggggguguugaccaaaggcaagagagcacucacaccuccagugaaugaucugaaauauucauggaagacaugggggaaagcaaaaaucuucaccccagaagcaagaaauagcacauuuuuaauagacggaccagacaccuccgaaugccccaaugaacgaagagcauggaacuuuuuggagguagaagacuauggauuuggcauguuuucgaccaacauauggaugaaauuccgagaaggaaguucagaagugugugaccauagauuaaugucggcggcaaucaaagaucagaaagcugugcaugcugacauggguuauuggauagagagcucaaaaaaccagaccuggcagauagagaaagcaucccuuauugaagugaaaacaugucuguggcccaaaacccacacgcuguggagcaauggagugcuggaaagucagaugcucauuccaagaucauaugcaggcccuuuuucacagcacaauuaccgccagggcuaugccacgcaaaucgcgggcccauggcacuuaggcaaauuggagauagacuuuggagaaugcccaggaacaacagucacgauucaggaggauugugaccauagaggcccaucuuugaggacuaccacugcaucuggaaaacuggucacgcaauggugcugccgcuccugcacgaugccucccuuaagguucuugggagaagauggauguugguaugggauggagauuaggcccuugagugaaaaagaagagaacauggucaaaucacaggugacagccggacaggguacaucagaaacuuuuucuaugggguugcuaugccugaccuuguucguggaagagugcuuaaggagaagagucacuaggaaacacaugauauugguugugacaaucaccuucugugcuaucaucuuaggaggucucacauggauggacuuacuacgagcccuuaucauguuaggggacacuaugucugguagaauagggggacagauucaccuagccauuauggcaguguucaagaugucaccaggauaugugcuggguguguuuuuaaggaaacuuacuucaagagagacagcgcuaaugguaauaggaauggccaugacaacgguguuuucaauuccacaugaccucauggaacucauugauggaauaucauugggguugauauuacuaaaaauaguaacacacuuugaugacacccaagugggaaccuuagcccuuucccugacuuucauaagaucaacaacaccauuagucauggcuuggaggaccaucauggcuguguucuuuguggucacacucauuccuuugugcaggacaagcugucuucaaaaacagucccauuggguggaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccuccuaaagaaugauguuccuuuagcuggcccaaugguggcaggaggcuuacuucuagcggcuuacguaaugagugguagcucagcagaccugucacuagagaaggcugccaaugugcagugggaugaaauggcggacauaacuggcucaagcccaaucauagaagugaagcaggaugaagauggcucuuuuuccauacgggaugucgaggaaaccaacaugauaacccucuuggugaaacuggcgcugauaacaguaucaggucuuuacccccuggcaauuccagucacaauggcacuaugguauauuuggcaagugaaaacacaaagaucaggagcucuaugggacguccccucaccuguugccacucagaaagccacacugucugaagggguguauaggaucaugcaaagaggguuguuuggaaaaacucagguuggaguagggauacacauggaagguguauuccacacaauguggcacgugacaagaggaucagugaucugccaugagacagggagauuagagccaucuugggcugacgucaggaaugacaugauaucauacggugggggauggaggcucggagacaaaugggacaaagaagaagauguucagguccuagccauagaaccagggaaaaauccuaaacauguccaaacgaaaccaggccuuuucaagacccuaacuggagaaauuggagcaguaacucuggauuucaaacccggaacgucuggcucucccaucauuaacaagaaagggaaaguuauuggacucuauggaaauggaguaguuaccaaaucaggugauuacgucagugccauaacgcaagccgaaagaauuggugagccagauuaugaaguggaugaggacauuuuucgaaagaaaagauuaacuauaauggacuuacacccuggagcuggaaagacaaaaagaauucucccaucaauagucagagaagcuuugaaaaggaggcugcgaaccuugauuuuggcucccacgagagugguggcggccgagauggaagaggcucuacgcggacugccaauccguuaucagaccccagcugugaaaucagagcacacaggaagagagauaguagaccucaugugucaugcaaccuucacaacgcgacuucugucaucaaccaggguuccaaauuauaaccucauagugauggaugaagcacauuucacugacccuuguagugucgcggcuagaggauacauuucaaccagaguggagaugggagaggcagcagcuaucuuuaugacugcaaccccuccuggaucgacagaucccuuuccccagagcaacagcccaauagaagacaucgagagggaaaucccagaaaggucauggaacacaggguucgacuggauaacagacuaccaagggaaaacugugugguucguuccuagcauaaaagcuggaaaugacauugcaaauuguuugagaaagucgggaaagagagugauccaguugagcagaaaaaccuuugacacagaguauccaaagacaaaacucacggacugggauuuuguggucaccacagacauaucugaaaugggggccaauuucagagcugggagaguaauagaccccaggagaugccucaagccaguuauccuaacagaugggccagagagaguuauucuagcagguccaauuccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuuuguggaauugaugaggagaggagaccuuccgguguggcugagcuacaagguagcuucggccgguaucucuuacaaagaccgagaauggugcuucacaggggaaaggaauaaccaaauuuuagaagaaaacauggagguugaaaucuggacuagagagggagaaaagaaaaaacuaaggccaaaaugguuagaugcacguguguacgcugaccccauggcucuaaaggauuucaaggaguuugccaguggaagaaagagcauaacccuugacauccuaacagagauugccacuuugccaacuuaccuuuccucuaaggccaagcuagcccuugacaacauagucaugcuccacacaacagaaaaaggagggagggccuaccaacacgcccugaacgaacucccggagucacuggaaacacucaugcuuguagcccuacuaggugcuaugacagccggcaucuuccuguuuuucaugcaggggaaaggaauagggaaauugucaauaggucugauagccauagcuguggcuaguggcuugcucuggguagcagaaauucagccccaguggauagcagcuucaauuauacuggaguuuuuucuuauggugcuguugauaccagaaccagaaaaacaaaggaccccacaagacaaucaauugaucuacguuauauugaccauucucaccauuauuggucucauagcagccaaugagauggggcugauugaaaaaacuaaaacggacuuuggguucuaccagguaaaaacagaaaccaccauucuugauguggauuugagaccagccucagcauggacacucuaugcaguggccaccacuauucugacucccaugcugagacacaccauagagaacacgucugccaaccuaucucuagcagccauugccaaccaagcagcuguccuaaugggacuuggaaaaggauggccgcuccacagaauggaccucggugugccgcuguuagcaaugggauguuauucucaagugaacccaacaacccugacagcaucccuagucaugcuuuuaguccauuaugccauaauagguccaggauugcaggcaaaagccacaagagaggcccagaaaaggacagcugcugggaucaugaagaaccccacgguggacgggauaacaguaauagaucuagaaccaauauccuaugacccaaaauuugaaaagcaauuagggcaagucaugcuacuaguacuguguguuggacaauuacuuuugaugagaacaacaugggcucucugcgaaguauugacuuuggcaacaggaccaaucaugaccuugugggagggcaacccgggaagguuuuggaacacgaccauagcuguaucaacagcuaacauuuuuagaggaagcuacuuggcgggagcuggacuagcuuuuucgcucauaaagaaugcacaaacccccaggaggggaacugggaccacaggagagacacugggagagaaguggaagagacagcuaaacucauuagacagaaaagaguuugaagaauacaaaagaaguggaauacuagaaguggauaggacugaagccaagucugcccuaagagauggaucuaagaucaagcaugcgguguccagagggucuaguaagaucagauggauuguugaaagagggaugauaaagccaaaaggaaaggucguggaucuugguugcgggaggggagguugguccuauuacauggcgacacucaagaacgugacugaagugaaaggauacacaaaaggagguccaggacaugaagaaccaauccccauggcuacuuauggcuggaauuuggucaaacuccauucagggguugauguguucuacaaacccacugagcagguggacacccugcucugugacauuggggagucauccucuaauccgacaauagaggaaggaagaacacugagagucuugaagaugguggagccauggcucucuucaaaaccugaguucugcaucaaaguccucaaccccuacaugccgacaguuauagaagagcuggaaaaacugcagagaagacaugguggaagccucgucagauguccgcuaucuaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcggguacgagaagugucuccacugaaacagaaaaaccagacaugacaaucauugggagaaggcuucagagauugcgagaagagcacaaagaaaccuggcacuaugaccaggaaaacccauacagaaccugggcguaucauggaagcuaugaagcuccuucgacaggcucagcaucuuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacccggcacacgaaugauuaugaccacgacagccaauugguugugggcccuccucgggaagaagaaaagucccagacugugcacaagggaagaguucaucucaaaaguuaggucaaaugcagccauaggcgcagucuuucaggaagagcagggauggacaucagccagugaagcugugaaugacagccgguucugggaacugguugacaaagaaagggcucugcaccaggaaggaaaaugugaaucgugugucuauaacaugaugggaaaacgugagaaaaaacugggagaguuugguagggcuaagggaagccgagcaaucugguacauguggcugggggcgcgguuccuggaauuugaagcccuggguuuuuugaaugaagaucacugguuuagcagagaaaacucauggaguggaguggaaggggaaggucugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacaucauauccaggaaagaccaaagagguaguggacagguuggaacauaugguuuaaacacauucacuaacauggaaguucaacucauccgccaaauggaagcugaaggagucaucacacaagacgacaugcagaacccaaaaggguuggaagaaagaguugagaaauggcugaaagaguguggcgucgacagguuaaagaggauggcaaucaguggagaugauugcguggugaagcccuuagaugagagguuuagcaccucccuccucuucuugaaugacaugggaaaggugaggaaagacaucccgcagugggaaccauccaagggauggaaaaacuggcaagagguuccuuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcucauguacuuccauagaagggaccugcgccuagccuccauggccauaugcucagcaguuccaacagaaugguuuccaauaagcagaacaacauggucaauccacgcucaucaccaguggaugaccacugaagauaugcuuaaaguguggaacagaguguggauagaagacaaccccaauaugacugacaagacuccaauccauucgugggaagacauaccuuaccuagggaaaagagaggaucugugguguggaucuuugauuggacuuucuuccagagccaccugggcgaagaacauucacacggccauaucucaggucaggaaucugaucggaaaagaggaauacguggauuacaugccagucaugaaaagauacagcgcucccuccgagagugaaggaguucuguaa

SEQ ID NO: 7855 - RNA, 9867 nt, Artificial Sequence
  derived and/or modified CDS sequence (wt) from DENV-4__KC762696__SS-prME
ucaacaaugacauugcuguguuugauucccaccguaauggcguuucaccugucaacaagagauggcgaaccccucaugauaguggcaaaacacgaaagggggagaccucucuuguuuaagacaacagaaggaaucaacaaaugcacccucauugccauggaccugggugaaaugugugaagacacugucacguauaaauguccucuacuggucaacaccgaaccugaagacauugauugcuggugcaaucucacguccaccugggucauguacgggacauguacccagagcggagaacggaggcgagaaaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauuggacaaacaggaauccagcgaacuguuuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagcuaaggaaguggcucuguuaagaaccuauugcauugaagcuucgauaucaaacauaaccacggcaacaagauguccaacgcaaggagagccuuaucucaaagaggaacaagaccagcaguacauuugccggagagaugugguagauagaggguggggcaauggcuguggcuuguuuggaaaaggaggaguugugacaugugcgaaguuuuuaugcucggggaagauaacaggcaaucugguccaaauugaaaaccuugaauauacgguaguugugacaguccacaauggagacacccaugcaguaggaaaugacacauccaaucauggagugacagccacgauaacucccaggucaccaucgguagaagucaaauugccggacuauggagaacuaacacucgauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucaugccaagagacaggaugugacagugcuaggaucucaggagggagcuaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauagguguuggagauagugcauuaacacuccauugguucaggaaagggagcuccauuggcaagauguuugagucuacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaaugucauguggaagcaaauaaccaacgagcuaaacuauguucucugggaaggaggacaugaccucacuguaguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcaggcccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacagcaucuggaaaacuggucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugacccuguucguggaagaaugcuuaaggagaagagucacuaggaaacacaugauauugguugugguaaucaccuucugugcuaucauccuaggaggucucacauggauggacuuacuacgagcccuuaucauguuaggggacaccaugucugguagaauaggaggacagauucaccuagccaucauggcaguguucaagaugucaccaggauaugugcuggguguguuuuuaaggaaacuuacuucaagagagacagcgcuaaugguaauaggaauggccaugacaacgguguuuucaauuccacaugaucucauggaacucauugauggaauaucauugggguugauaauacuaaaaauaguaacacacuuugauaacacccaagugggaacuuuagcccuuucccugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccucuuaaagaaugauguuccuuuagcuggcccaaugguggcaggaggcuuacuucuagcggcuuacguaaugagugguagcucagcagaccugucacuagagaaggcugcuaaugugcaaugggaugaaauggcggacauaacuggcucaagcccgaucauagaagugaagcaggaugaagauggcucuuucuccauacgggacgucgaggaaaccaacaugauaacccucuuggugaaacuggcgcugauaacaguaucaggucuuuaccccuuggcaauuccaguuacaauggcacuaugguauguuuggcaagugaaaacacaaagaucaggagcucugugggacguccccucacccgcugccacucagaaagccacacugucugaagggguguauaggaucaugcaaagaggguuguucgggaaaacucagguuggaguggggauacacauggaagguguauuccacacaauguggcacguaacaagaggaucagugaucugccaugagacagggagauuagagccaucuugggcugacgucaggaaugacaugauaucauacggugggggauggaggcucggagacaagugggacaaagaagaagauguucagguccuagccauagaaccaggaaaaaauccuaaacacguccaaacgaaaccaggccuuuucaagacccuaacuggagaaauuggagcaguaacucuggauuucaaacccggaacgucuggcucuccuaucauaaacaagaaagggaaaguuauuggacucuauggaaaugggguaguuaccaaaucaggugauuacgucagugccauaacgcaagccgaaagaauuggugagccagauuaugaaguggaugaggacaucuuucgaaagaaaagauuaaccauaauggacuuacaccccggagccggaaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacugugugguuuguucccagcauaaaagcuggaaaugacauugcaaauuguuugagaaagucgggaaagagagugauccaguugagcagaaaaaccuuugacacagaguauccaaagacgaaacuuacggacugggauuuuguggucaccacagacauaucugaaaugggagccaauuucagagcugggagagugauagaccccaggagaugccucaagccaguuauccugacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacguuguuugguccggaaagggaaaaaacccaagcuauugauggagaguuucgccucagaggggaacaaaggaagacuuuuguggaauugaugaggagaggagaccuuccgguguggcugagcuauaagguagcuucugccgguauaucuuacaaagaccgagaauggugcuucacaggggaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccaucauuggucuuauagcagcuaaugagauggggcugauugaaaaaacaaaaacggacuuuggguucuaccagguaaaaacagaaaccaccauucuugauguggauuugagaccagccucagcguggacacucuaugcaguggccaccacuauucugacucccaugcugagacacaccauagagaacacgucugccaaccuaucucuagcagccauugccaaccaagcagcuguccuaaugggacuuggaaaaggauggccgcuccacaggauggaccucggugugccgcugcuagcaaugggauguuauucucaagugaacccaacaaccuugacagcaucccuaguuaugcuuuuaguucauuaugccauaauagguccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaagugcugacucuggccacaggaccagucaugaccuugugggagggcaacccgggaagguuuuggaacacaaccauagcuguauccacagcuaacauuuuuagaggaagcuacuuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguagauaggacugaagccaagucugcccuaagagauggauccaaaaucaaguaugcgguguccagagggucuaguaagaucagauggauuguugaaagaggaaugauaaaaccaaaaggaaaggucguagaucuugguugcgggaggggaggaugguccuauuacauggcgacacucaagaacgugacugaagugaaaggauauacuaaaggagguccaggacaugaagaaccaauccccauggcuacuuauggcuggaauuuggucaaacuccauucaggaguugauguguucuacaaacccacagagcagguggacacccugcuuugugacauuggggagucauccucuaauccgacaauagaggaaggaagaacauugagagucuugaagaugguggagccauggcucucuucaaaaccugaguucugcaucaaaguccucaaucccuacaugccgacaguuauagaggagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcgagaagagcacaaagaaaccuggcacuaugaccaggaaaacccauacagaaccugggcguaucauggaagcuaugaagccccuucgacaggcucagcauccuccauggugaacgggguaguaaaacugcugacaaaaccuugggaugugauuccaauggugacucaguuggccaugacagacacaaccccuuuuggacaacaaagaguauucaaggagaagguggauaccagaacaccacaaccaaaacccggcacacggaugauuaugacuacgacagccaauugguugugggcccuccucgggaagaagaaaaguccuagacugugcacaagggaagaguucaucucaaaaguuaggucaaaugcagccauaggcgcagucuuucaggaagaacagggauggacaucagccagugaggcugugaaugacagccgguucugggaacugguugacaaagaaagggcucugcaccaggaaggaaaaugugaaucgugugucuacaacaugaugggaaagcgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggggaaggucugcauagauugggauacaucuuggaggacauagacaagaaggauggagaccugauauaugcugacgacacagcaggcugggacacgagaaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaccaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagagugcggcgucgacagguugaagaggauggcaaucaguggagaugauugcguggugaagcccuuagaugagagguuuagcaccucccuccucuucuugaaugauaugggaaaggugaggaaagauaucccgcagugggaaccauccaagggauggaaaaacuggcaagagguuccuuuuugcucccaccauuuccacaagaucuucaugaaagauggccgcucacugguuguuccaugcagaaacccggaugaacugauaggaagagccagaaucucgcagggggcuggauggagcuugagagaaacagccugucugggcaaagcuuacgcccagauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaacccuaauaugacugacaagacuccaguccauucgugggaagacauaccuuaccuagggaaaagagaggaucuguggugcggaucccugauuggacuuucuuccagagccaccugggcgaagaacauucacacggccauaacccaggucaggaaucugaucggaaaagaggaauacguggauuacaugccagccaugaaaagauacagcgcuccuuucgagagugaaggaguucuguaa

SEQ ID NO: 7856 - RNA, 9867 nt, Artificial Sequence
  derived and/or modified CDS sequence (wt) from DENV-4__KC762697__SS-prME
ucaacaaugacauugcuguguuugauucccaccgcaauggcguuucaccugucaacaagagacggcgaaccccucaugauaguggcaaaacacgaaagggggagaccucucuuguuuaagacaacagaaggaaucaauaaaugcacccucauagccauggaccugggugaaaugugugaagacacugucacguauaaauguccucuauuaguuaacaccgaaccugaagacauugauugcuggugcaaucucacguccaccuggguuauguacgggacaugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuucuggcaggauuuauggcuuacaugauugggcaaacaggaauccagcgaacuguuuucuuuguccuaaugaugcuaguugccccauccuacggaaugcgaugcguagggguagggaacagagacuuuguggaaggagucucggguggagcaugggucgacuuggugcuagaacauggaggaugugucacaaccauggcccagggaaaaccaaccuuggauuuugaacugaccaagacaacagcuaaggaaguagcucuguuaagaaccuauugcauugaagccucgauaucgaacauaaccacggcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauauacgguaguugugacaguccacaauggagacacccaugcaguaggaaaugacacauccaaucauggagugacagcuacgauaacucccaggucaccaucgguagaaguuaaauugccggacuauggagaacuaacacucgauugugaacccagguccggaauugauuucaaugagaugauccugaugaaaaugaaaaagaaaacguggcuugugcacaagcaaugguuuuuggaccuaccucuaccguggacagcaggagcagacacaucagaaguccauuggaauuauaaagagagaauggugacauucaaaguuccucaugccaagagacaggaugugacagugcuaggaucucaggagggagcuaugcauucugcccucgccggagccacagaaguggauucuggugauggaaaucacauguuugcaggacaucucaagugcaaaguucguauggagaaauugagaauuaagggaaugucauacacgauguguucagggaaguucucaauugacaaagagauggcagaaacacagcaugggacaacaguggugaaagucaaguaugaaggcgcuggagccccauguaaaguucccauagagauaagagaugugaacaaggaaaaaguaguugggcgcaucaucucauccaccccuuuugccgagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuuggcucuguugguggacuguuuacaucacugggaaaggcuguacaccaaguuuuuggaaguguguauacaaccauguuuggaggggucucauggaugaucagaauccuaauugggcucuuaguauuguggauuggcacgaauucaagaaacacuucaauggcaaugacgugcauagcuguuggaggaaucacucuguuucuagguuucacaguucaagcagacauggguuguguggugucauggaaugggaaggaacuaaaauguggaagcggaauuuuugugguugacaaugugcauacuuggacagaacaguacaaauuccaaccagaguccccagcgaggcuagcuucugcaauauugaaugcccacaaagauggggucuguggaaucagaucaaccacgaggcuggaaaauguuauguggaagcaaauaaccaacgagcuaaacuauguucucugggaaggaggacaugaccucacuguaguggccggggacgugaaggggguguugaccaaaggcaagagaguacucacaccuccagugaaugaucugaaauauucauggaagacaugggggaaagcaaaaaucuucaccccagaagcaagaaauagcacauuuuuaauagacggaccagacaccuccgaaugccccaaugaacgaagagcauggaacuuuuuugagguagaagacuauggauuuggcauguuuucgaccaacauauggaugaaauuccgagaaggaagcucagaagugugugaucauagauuaaugucggcggcaaucaaagaucagaaagcugugcaugcugacauggguuauuggauagagagcucaaaaaaccagaccuggcagauagagaaagcaucccuuauugaagugaaaacaugucuguggcccaaaacccacacgcuguggagcaauggagugcuggaaagucagaugcucauuccaagaucauaugcaggcccuuuuucacagcacaauuaccgccagggcuaugccacgcaaaucgcgggcccauggcacuuaggcaaauuggagauagacuuuggagaaugccccggaacaacagucacgauucaggaggauugugaccauagaggcccaucuuugaggaccaccacugcaucuggaaaacuggucacgcaauggugcugccgcuccugcacgaugccucccuuaagguucuugggagaagauggauguugguaugggauggagauuaggcccuugagugaaaaagaagagaacauggucaaaucacaggugacagccggacaggguacaucagaaacuuuuucuaugggguuguuaugccugaccuuguucguggaagagugcuuaaggagaagagucacuaggaaacacaugauauugguuguggcaauuaccuucugugcuaucaucuuaggaggccucacauggauggacuuacuacgagcccuuaucauguuaggggacacuaugucugguagaauaggaggacagauucaccuagccauuauggcaguguucaagaugucaccaggauaugugcuggguguguuuuuaaggaaacuuacuucaagagagacagcgcuaaugguaauaggaauggccaugacaacgguguuuucaauuccacaugaccucauggaacucauugauggaauaucauugggguugauauugcuaaaaauaguaacacacuuugaugacacccaagugggaaccuuagcccuuuccuugacuuucauaagaucaacaacaccauuagucauggcuuggaggacaaucauggcuguguucuuuauggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccuccuaaagaaugauguuccuuuagcuggcccaaugguggcaggaggcuuacuucuagcggcuuacguaaugagugguagcucagcagaccugucacuagagaaggcugccaaugugcagugggaugaaauggcggacauaacuggcucaagcccaaucauagaagugaagcaggaugaagauggcucuuuuuccauacgggaugucgaggaaaccaacaugauaacccucuuggugaaacuggcgcugauaacaguaucaggucuuuacccuuuggcaauuccagucacaauggcacuaugguauauuuggcaagugaaaacacaaagaucaggagcucuaugggacguccccucaccugcugccacucagaaagccacacugucugaagggguguauaggaucaugcaaagaggguuguuuggaaaaacucagguuggaguagggauacacauggaagguguauuccacacaauguggcacgugacaagaggaucagugaucugccaugagacagggagauuggagccaucuugggcugacgucaggaaugacaugauaucauacggugggggauggaggcucggagacaaaugggacaaagaagaagacguucagguccuagccauagaaccaggaaaaaauccuaaacauguccaaacgaaaccaggccuuuucaagacccuaacuggagaaauuggagcaguaacucuggauuucaaacccggaacgucuggcucucccaucauuaacaagaaagggaaaguuauuggacucuauggaaauggaguaguuaccaaaucaggugauuacgucagugccauaacgcaagccgaaagaauuggugagccagauuaugaaguggaugaggacauuuuucgaaagaaaagauuaacuauaauggacuuacacccuggagcuggaaagacaaaaagaauucucccaucaauagucagagaagcuuugaaaaggaggcugcgaaccuugauuuuggcucccacgagagugguggcggccgagauggaagaggcccuacgcggacugccaauccguuaccagaccccagcugugaaagcagagcacacaggaagagagauuguagaccucaugugucaugcaaccuucacaacgcgacuucugucaucaaccaggguuccaaauuauaaccucauagugauggaugaagcacauuucacugacccuuguagugucgcggcuagaggauacauuucaaccaggguggagaugggagaggcagcagcuaucuuuaugacugcaaccccuccuggaucgacagaucccuuuccccagagcaacagcccaauagaagacaucgagagggaaaucccagaaaggucauggaacacaggguucgacuggauaacagacuaccaagggaaaacugugugguucguuccuagcauaaaagcuggaaaugacauugcaaauuguuugagaaagucgggaaagagagugauccaguugagcagaaaaaccuuugacacagaguauccaaagacgaaacucacggacugggauuuuguggucaccacagacauaucugaaaugggggccaauuucagagcugggagagugauagaccccaggagaugccucaagccaguuauccuaacagaugggccagagagaguuauucuagcaggcccaauuccaguaacuccagcaagugccgcucagagaagagggcgaauaggucggaauccagcgcaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuuuguggaauugaugaggagaggagaccuuccgguguggcugagcuacaagguagcuucugccggcaucucuuacaaagaccgagaauggugcuucacaggggaaaggaauaaccaaauuuuagaagaaaacauggagguugaaaucuggacuagagagggagaaaagaaaaaacuaaggccaaaaugguuagaugcacguguguacgcugaccccauggcucuaaaggauuucaaggaguuugccaguggaagaaagagcauaacccuugacauccuaacagagauugccacuuugccaacuuaccuuuccucuaaggccaagcuagcccuugacaacauagucaugcuccacacaacagaaaagggagggagggccuaccaacacgccuugaacgaacucccggagucacuggaaacacucaugcuuguagcccuacuaggugcuaugacagccggcaucuuccuguuuuucaugcaggggaaaggaauaggaaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccauuauuggucucauagcagccaaugagauggggcugauugaaaaaacuaaaacggacuuuggguucuaccaggcaaaaacagaaaccaccauucuugauguggauuugagaccagccucagcauggacacucuaugcaguggccaccacuauucugacucccaugcugagacacaccauagagaacacgucugccaaccuaucucuagcagccauugccaaccaagcagcuguccuaaugggacuuggaaaaggauggccgcuccacagaauggaccucggugugccgcuguuagcaaugggauguuauucucaagugaacccaacaacccugacagcaucccuagucaugcuuuuaguccauuaugccauaauagguccaggauugcaggcaaaagccacaagagaggcccagaaaaggacagcugcugggaucaugaagaaccccacgguggacgggauaacaguaauagaucuagaaccaauauccuaugacccaaaauuugaaaagcaauuagggcaagucaugcuacuaguacuauguguuggacaauuacuuuugaugagaacaacaugggcucucugcgaaguauugacuuuggcaacaggaccaaucaugaccuugugggagggcaacccgggaagguuuuggaacacgaccauagcuguaucaacagcuaacauuuuuagaggaagcuacuuggcgggagcuggacuagcuuuuucgcucauaaagaaugcacaaacccccaggaggggaacugggaccacaggagagacacugggagagaaguggaagagacagcuaaacucauuagacagaaaagaguuugaagaauacaaaagaaguggaauacuagaaguggauaggacugaagccaagucugcccuaagagauggaucuaagaucaaguaugcgguguccagagggucuaguaagaucagauggauuguugaaagagggaugguaaagccaaaaggaaaggucguggaucuugguugcgggaggggaggaugguccuauuacauggcaacacucaagaacgugacugaagugaaaggauacacaaaaggagguccaggacaugaagaaccaauccccauggcuacuuauggcuggaauuuggucaaacuccauucagggguugauguguucuacaaacccacugagcagguggacacccugcucugugacauuggggagucauccucuaauccaacaauagaggaaggaagaacacugagagucuugaagaugguggagccauggcucucuucaaaaccugaguucugcaucaaaguccucaaccccuacaugccgacaguuauagaagagcuggaaaaacugcagagaagacaugguggaagccucgucagauguccgcuaucuaggaauucuacccaugagauguacugggugucaggugcgucgggaaacaucgugaguucugugaacacaauaucaaagaugcuguugaacagguucacaacaaggcauaggaaacccacuuaugagaaggacguagaucuuggggcgggaacgagaagugucuccacugaaacagaaaaaccagacaugacaaucauugggagaaggcuucagagauugcgagaagagcacaaagaaaccuggcacuaugaccaggaaaacccauacagaaccugggcguaucauggaaguuaugaagcuccuucgacaggcucagcaucuuccauggugaacgggguaguaaaacugcugacaaaaccuugggaugugauuccaauggugacccaguuggccaugacagacacaaccccuuuugggcaacaaagaguguucaaagagaagguggauaccagaacaccacaaccaaaacccggcacacgaaugauuaugaccacgacagccaauugguugugggcccuccucgggaagaagaaaagucccagacugugcacaagggaagaguucaucucaaaaguuaggucaaaugcagccauaggcgcagucuuucaggaagaacagggauggacaucagccagugaagcugugaaugacagccgguucugggaacugguugacaaagaaagggcucugcaccaggaaggaaaaugugaaucgugugucuauaacaugaugggaaaacgugagaaaaaacugggagaguuugguagggcuaagggaagccgagcaaucugguacauguggcugggggcgcgguuccuggaauuugaagcccuggguuuuuugaaugaagaucacugguuuagcagagaaaacucauggaguggaguggaaggggaaggucugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagaccuuagccaaagccauuuucaaacuaaccuaucaaaacaaaguggugaaaguccucagacccacaccgaaaggagcgguaauggacauuauauccaggaaagaccaaagagguaguggacagguuggaacauaugguuuaaacacauucacuaacauggaaguucaacucauccgccaaauggaagcugaaggagucaucacacaagacgacaugcagaacccaaaaggguuggaagaaagaguugagaaauggcugaaagaguguggcgucgacagguuaaagaggauggcaaucaguggagaugauugcguggugaagcccuuagaugagagguuuagcaccucccuccucuucuugaaugacaugggaaaggugaggaaagacaucccgcagugggaaccauccaagggauggaaaaacuggcaagagguuccuuuuugcucccaccauuuucacaagaucuucaugaaagauggccgcucacuggucguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacagaaugguuuccaacaagcagaacaacauggucaauccacgcucaccaccaguggaugaccacugaagauaugcuuaaaguguggaacagaguguggauagaagacaaccccaauaugacugacaagacuccaauccauucgugggaagacauaccuuaccuagggaaaagagaggaucugugguguggaucucugauuggacuuucuuccagagccaccugggcgaagaacauucacacggccauaacucaggucaggaaucugaucggaaaagaggaauacguggauuacaugccagucaugaaaagauacagcgcuccuuccgagagugaaggaguucuguaa

SEQ ID NO: 7857 - RNA, 9867 nt, Artificial Sequence
  derived and/or modified CDS sequence (wt) from DENV-4__KC762698__SS-prME
ucaacaaugacauugcuguguuugauucccaccguaauggcguuucaccugucaacaagagauggcgaaccccucaugauaguggcaaaacacgaaagggggagaccucucuuguuuaagacaacagaaggaaucaacaaaugcacccucauugccauggaccugggugaaaugugugaagacacugucacguauaaauguccucuacuggucaacaccgaaccugaagacauuguuugcuggugcaaucucacguccaccugggucauguacgggacauguacccagagcggagaacggaggcgagaaaagcgcucaguagcuuuaacaccacauucaggaaugggauuggaaacaagagcugagacauggaugucaucggaaggggccuggaaacaugcucagagaguggaaagcuggauacucagaaacccaggauucgcgcuccuggcaggauuuauggcuuacaugauugggcaaacaggaauccagcgaacuguuuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagccaaggaaguggcucugcuaagaaccuauugcauugaagcuucgauaucaaacauaaccacggcaacaagaugcccaacgcaaggagagccuuaucucaaagaggaacaagaccagcaguacauuugccggagagaugugguagauagaggguggggcaauggcuguggcuuguuuggaaaaggaggaguugugacaugugcgaaguuuuuauguucggggaagauaacaggcaaucugguccaaauugaaaaccuugaauauacgguaguugugacaguccacaauggagacacccaugcaguaggaaaugacacauccaaucauggagugacagccacgauaacucccaggucaccaucgguagaagucaaauugccggacuauggagaacuaacacucgauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucaugccaagagacaggaugugacagugcuaggaucucaggagggagcuaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauaggugcuggagauagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaaugucauguggaagcaaauaaccaacgaguuaaacuauguucucugggaaggaggacaugaccucacugugguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguucacgaccaacauauggaugaaauuccgagaaggaaguucagaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcagguccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacugcaucuggaaaacuggucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugaccuuguucguggaagaaugcuuaaggagaagagucacuaggaaacacaugauauugguugugguaaucaccuucugugcuaucauccuaggaggucucacauggauggacuuacuacgagcccuuaucauguuaggggacacuaugucugguagaauaggaggacagauucaccuagccaucauggcaguguucaagaugucaccaggauaugugcuggguguguuuuuaaggaaacuuacuucaagagagacagcgcuaaugguaauaggaauggccaugacaacgguguuuucaauuccacaugaucucauggagcucauugauggaauaucauugggguugauauuacuaaaaauaguaacacacuuugauaacacccaagugggaacuuuagcccuuucccugacuuucauaagaucaacaacaccauuagucauggcuuggaggaccaucauggcuguguuuuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccucuuaaaaaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccaaucauagaagugaagcaggaugaagauggcucuuucucuauacgggacgucgaggaaaccaacaugauaacccucuuggugaaacuggcgcugauaacaguaucaggucuuuaccccuuggcaauuccagucacaauggcacuaugguauguuuggcaagugaaaacacaaagaucaggagcucugugggacguccccucacccgcugccacucagaaagccacacugucugaagggguguauaggaucaugcaaagaggguuguucgggaaaacucagguuggaguggggauacacauggaagguguauuccacacaauguggcacguaacaagaggaucagugaucugccaugagacagggagauuagagccaucuugggcugacgucaggaaugacaugauaucauacggugggggauggaggcucggagacaagugggacaaagaagaagauguucagguccuagccauagaaccaggaaaaaauccuaaacauguccaaacgaaaccaggccuuuucaagacccuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacaucuuucgaaagaaaagauuaaccauaauggacuuacaccccggagccggaaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacugugugguuuguucccagcauaaaagcuggaaaugacauugcaaauuguuugagaaagucgggaaagaaagugauccaguugagcagaaaaaccuuugacacagaguauccaaagacgaaacucacggacugggauuuuguggucaccacagacauaucugaaaugggagccaauuucagagcugggagagugauagaccccaggaggugccucaagccaguuauccuaacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacauuguuugguccggaaagagaaaaaacccaagcuauugauggagaguuucgccucagaggggaacaaaggaagacuuuuguggaauugaugaggagaggagaccuuccgguguggcugagcuacaagguagcuucugccggcauaucuuacaaagaccgagaauggugcuucacaggggaaaggaauaaccaaauuuuagaagaaaacauggagguugaaaucuggacuagagagggagaaaagaaaaagcuaaggccaaaaugguuagaugcacguguguacgcugaccccauggccuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccauuauuggucuuauagcagccaaugagauggggcugauugaaaaaacaaaaacggacuuuggguucuaccagguaaaaacagaaaacaccauucuugauguggauuugagaccagccucagcguggacacucuaugcaguggccaccacuauucugacucccaugcugagacacaccauagagaacacgucugccaaccuaucucuggcagccauugccaaccaagcagcuguccuaaugggacuuggaaaaggauggccgcuccacaggauggaccucggugugccgcugcuagcaaugggauguuauucucaagugaacccaacaaccuugacagcaucccuaguuaugcuuuuaguucauuaugcuauaauagggccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaaguacugacucuggccacaggaccagucaugaccuugugggagggcaacccgggaagguuuuggaacacaaccauagcuguauccacagcuaacauuuuuagaggaagcuacuuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaagagauggauccaaaaucaaguaugcgguguccagagggucuaguaagaucagauggauuguugaaagaggaaugauaaaaccaaaaggaaaggucguagaucuugguugcgggaggggaggaugguccuauuacauggcgacacucaagaacgugacugaagugaaaggauauacuaaaggagguccaggacaugaagaaccaauccccauggcuacuuauggcuggaauuuggucaaacuccauucaggaguugauguguucuacaaacccacagagcagguggacacccugcuuugugacauuggggagucauccucuaauccgacaauagaggaaggaagaacauugagagucuugaagaugguggagccauggcucucuucaaaaccugaguucugcaucaaaguccucaaccccuacaugccgacaguuauagaagagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaauagaaaaaccagacaugacaaucauugggagaaggcuucagagauugcgagaagagcacaaagaaaccuggcacuaugaccaugaaaacccauacagaaccugggcguaucaugggagcuaugaagccccuucgacagguucagcauccuccauggugaacgggauaguaaaacugcugacaaaaccuugggaugugauuccaauggugacucaguuggccaugacagacacaaccccuuuugggcaacaaagaguguucaaggagaagguggauaccagaacaccacaaccaaaacccggcacacggaugaucaugaccacgacagccaauugguugugggcccuccucgggaagaagaaaagucccagacugugcacaagggaagaguucaucucgaaaguuaggucaaaugcagccauaggcgcagucuuucaggaagaacagggauggacaucagccagugaagcugugaaugacagccgguucugggaacugguugacaaagaaagggcucugcaccaggaaggaaaaugugaaucgugugucuacaacaugaugggaaaacgugagaaaaaauuaggagaguuugguagggccaagggaagccgagcaauuugguacauguggcugggggcgcgguuccuggaauuugaagcccuggguuuuuugaaugaagaucacugguuuagcagagaaaacucauggaguggaguggaaggggaaggucugcacagauugggauacaucuuggaggacauagacaagaaggauggagaccugauauaugcugacgacacagcaggcugggacacgagaaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaccaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagaguguggcgucgacagguuggagaggauggcaaucaguggagaugauugcguggugaagcccuuagaugagagguuuagcaccucccuccucuucuugaaugauaugggaaaggugaggaaagauaucccgcagugggaaccauccaagggauggaaaaacuggcaagagguuccuuuuugcucccaccauuuccacaagaucuucaugaaagauggccgcucacugguuguuccaugcagaaaccaggaugaacuaauaggaagagccagaaucucgcagggggcuggauggagcuugagagaaacagccugucugggcaaagcuuacgcucagaugugguugcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaaccccaauaugacugacaagacuccaguccauucgugggaagacauaccuuaccuagggaaaagagaggaucuguggugcggaucccugauuggacuuucuuccagagccaccugggcgaagaacauucacacggccauaacccaggucaggaaucugaucggaaaagaggaauacguggauuacaugccagccaugaaaagauacagcgcuccuuucgagagugaaggaguucuguaa

SEQ ID NO: 7858 - RNA, 9867 nt, Artificial Sequence
  derived and/or modified CDS sequence (wt) from DENV-4__KC762699__SS-prME
ucaacaaugacauugcuguguuugauucccaccguaauggcguuucaccugucaacaagagauggcgaaccccucaugauaguggcaaaacacgaaagggggagaccucucuuguuuaagacaacagaaggaaucaacaaaugcacccucauugccauggaccugggugaaaugugugaagacacugucacguauaaauguccucuacuggucaacaccgaaccugaagacauugauugcuggugcaaucucacguccaccugggucauguacgggacauguacccagagcggagaacggaggcgagaaaagcgcucaguagcuuuaacaccacacucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaacuguuuucuuuguccuaaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaacugaccaagacaacagcuaaggaaguggcucuguuaagaaccuauugcauugaagcuucgauaucaaacauaaccacggcaacaagauguccaacgcaaggagagccuuaucucaaagaggaacaagaccagcaguacauuugccggagagaugugguagauagaggguggggcaauggcuguggcuuguuuggaaaaggaggaguugugacaugugcgaaguuuuuaugcucggggaagauaacaggcaaucugguccaaauugaaaaccuugaauauacgguaguugugacaguccacaauggagacacccaugcaguaggaaaugacacauccaaucauggagugacagccacgauaacucccaggucaccaucgguagaagucaaauugccggacuauggagaacuaacacucgauugugaacccagguccggaauugacuucaaugagaugauccugaugaaaaugaaaaagaaaacguggcuugugcacaagcaaugguuuuuggaccuaccccuaccauggacagcaggagcagacacaucagaaguucauuggaauuauaaagagagaauggugacauucaaaguuccucaugccaagagacaggaugugacagugcuaggaucucaggagggagcuaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguacgaaggcgcuggagcuccguguaaaguucccauagagauaagagaugugaacaaggaaaaaguaguugggcgcaucaucucaucuaccccuuuugcugagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauucuaggugaaacagcuugggauuuugguucuguugguggacuguucacaucacugggaaaggcuguacaccaaguuuuuggaaguguguauacaaccauguuuggaggggucucauggaugauuagaauucuaauuggguucuuaguauuguggauuggcacgaauucaagaaauacuucaauggcaaugacgugcauagcuguugggggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaaugucauguggaagcaaauaaccaacgagcuaaacuauguucucugggaaggaggacaugaccucacuguaguggcuggggacgugaaagggguguugaccaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucggaagugugugaccauagauuaaugucggcggcaauuaaagaucagaaagcugugcaugcugacauggguuauuggauagagagcucaaaaaaccagaccuggcaaauagagaaagcaucccuuauugaagugaaaacaugccuguggcccaaaacccacacguuguggagcaauggagugcuggaaagucagaugcucauuccaagaucauaugcaggcccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacagcaucuggaaaacuggucacgcaguggugcugccgcuccugcacgaugccccccuuaagguucuugggagaagauggaugcugguacgggauggagauuaggcccuugagugaaaaagaagagaacauggucaaaucacagguaacagccggacaggguacaucagaaacuuuuucuauggggcugcuaugccugacccuguucguggaagaaugcuuaaggagaagagucacuaggaaacacaugauauugguugugguaaucaccuucugugcuaucauccuaggaggucucacauggauggacuuacuacgagcccuuaucauguuaggggacaccaugucugguagaauaggaggacagauucaccuagccaucauggcaguguucaagaugucaccaggauaugugcuggguguguuuuuaaggaaacuuacuucaagagagacagcgcuaaugguaauaggaauggccaugacaacgguguuuucaauuccacaugagcucauggaacucauugauggaauaucauugggguugauauuacuaaaaauaguaacacacuuugauaacacccaagugggaacuuuagcccuuucccugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccuccuaaagaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccgaucauagaagugaagcaggaugaagauggcucuuucuccauacgggacgucgaggaaaccaacaugauaacccucuuggugaaacuggcgcugauaacaguaucaggucuuuaccccuuggcaauuccaguuacaauggcacuaugguauguuuggcaagugaaaacucaaagaucaggagcucugugggacguccccucacccgcugccacucagaaagccacacugucugaagggguguauaggaucaugcaaagaggguuguucgggaaaacucagguuggaguggggauacacauggaagguguguuccacacaauguggcacguaacaagaggaucagugaucugccaugagacagggagauuagagccaucuugggcugacgucaggaaugacaugauaucauacggugggggauggaggcucggagacaagugggacaaagaagaagauguucagguccuagccauagaaccaggaaaaaauccuaaacauguccaaacgaaaccaggccuuuucaagacccuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacaucuuccgaaagaaaagauuaaccauaauggacuuacaccccggagccggaaaaacaaaaagaauucucccaucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacaucucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacugugugguuuguucccagcauaaaagcuggaaaugacauugcaaauuguuugagaaagucgggaaagagagugauccaguugagcagaaaaaccuuugacacagaguauccaaagacgaaacucacggacugggauuuuguggucaccacagacauaucugaaaugggagccaauuucagagcugggagagugauagaccccaggagaugccucaagccaguuauccugacagaugggccagagagaguuauucuagcagguccaauuccaguaacuccagcaagugccgcucagaggagagggcgaauagguaggaauccagcacaagaagaugaccaauauguuuucuccggagacccacuaaagaaugaugaagaucaugcucacuggacagaagcaaagauguugcuugacaauaucuacacuccugaagggauaauuccaacauuguuugguccggaaagggaaaaaacccaagcuauugauggagaguuucgccucagaggggaacaaaggaagacuuuuguggaauugaugaggagaggagaccuuccgguguggcugagcuauaagguagcuucugccgguauaucuuacaaagaccgagaauggugcuucacaggggaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuucacacaacagaaaaaggagggagggccuaccaacaugcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccaucauuggucuuauagcagccaaugagauggggcugauugaaaaaacaaaaacggacuuuggguucuaccagguaaaaacagaaaccaccauucuugauguggauuugagaccagccucagcguggacacucuaugcaguggccaccacuauucugacucccaugcugaggcacaccauagagaacacgucugccaaccuaucucuagcagccauugccaaccaagcagcuguccuaaugggacuuggaaaaggauggccgcuccacaggauggaccucggugugccgcugcuagcaaugggauguuauucucaagugaacccaacaaccuugacagcaucccuaguuaugcuuuuaguucauuaugccauaauagguccaggauugcaggcaaaagccacaagagaggcccagaaaaggacagcugcugggaucaugaaaaaccccacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaagugcugacucuggccacaggaccagucaugaccuugugggagggcaacccgggaagguuuuggaacacaaccauagcuguaucuacagcuaacauuuuuagaggaagcuaccuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaagagauggauccaaaaucaaguaugcgguguccagagggucuaguaagaucagauggauuguugaaagaggaaugauaaaaccaaaaggaaaggucguagaucuugguugcgggaggggaggaugguccuauuacauggcgacacucaagaacgugacugaagugaaaggauauacuaaaggagguccaggacaugaagaaccaauccccauggcuacuuauggcuggaauuuggucaaacuccauucaggaguugauguguucuacaaacccacagagcagguggacacccugcuuugugacauuggggagucauccucuaauccgacaauagaggaaggaagaacauugagagucuugaagaugguggagccauggcucucuucaaaaccugaguucugcaucaaaguccucaaucccuacaugccgacaguuauagaggagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcgagaagagcacaaagaaaccuggcacuaugaccaggaaaacccauacagaaccugggcguaucauggaagcuaugaagccccuucgacaggcucagcauccuccauggugaacgggguaguaaaacugcugacaaaaccuugggaugugauuccaauggugacucaguuggccaugacagacacaaccccuuuugggcaacaaagaguauucaaggagaagguggauaccagaacaccacaaccaaaacccggcacacggaugauuaugaccacgacagccaauugguugugggcccuccucgggaagaagaaaaguccuagacugugcacaagggaagaguucaucucaaaaguuaggucaaaugcagccauaggcgcagucuuucaggaagaacagggauggacaucagccagugaggcugugaaugacagccgguucugggaacugguugacaaagaaagggcucugcaccaggaaggaaaaugugaaucgugugucuacaacaugaugggaaagcgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggggaaggucuacauagauugggauacaucuuggaggacauagacaagaaggauggagaccugauauaugcugacgacacagcaggcugggacacgagaaucacugaagaugaccuuuuaaaugaagaacugaucacagaacagauggccccucaccacaagacccuagccaaagccauuuucaaacuaaccuaucaaaacaaaguggugaaaguucucagacccacaccgaaaggagcgguaauggacauuauauccaggaaagaucaaagagguaguggacagguuggaacauaugguuuaaacacauucacuaacauggaaguccaacucauccgccaaauggaagcugaaggagucaucacacaagacgacaugcagaacccaaaaggguugaaagaaagagucgagaaauggcugaaagaguguggcgucgacagguugaagaggauggcaaucaguggagaugauugcguggugaagcccuuagaugagagguuuagcaccucccuccucuucuugaaugauaugggaaaggugaggaaagauaucccgcagugggaaccauccaagggauggaaaaacuggcaagagguuccuuuuugcucccaccauuuccacaagaucuucaugaaagauggccgcucacugguuguuccaugcagaaaccaggaugaacugauaggaagagccagaauuucgcagggggcuggauggagcuugagagaaacagccugucugggcaaagcuuacgcccagauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaacccuaauaugacugacaagacuccaguccauucgugggaagacauaccuuaccuagggaaaagagaggaucuguggugcggaucccugauuggacuuucuuccagagccaccugggcgaagaacauucacacggccauaacccaggucaggaaucugaucggaaaagaggaauacguggauuacaugccagccaugaaaagauacagcgcuccuuucgagagugaaggaguucuguaa

SEQ ID NO: 7859 - RNA, 9867 nt, Artificial Sequence
  derived and/or modified CDS sequence (wt) from DENV-4__JQ915085__SS-prME
ucaacaaugacauugcuguguuuaauuccuaccguaauggcguuucaccugucaacaagagacggcgaaccccucaugauaguggcaaaacacgaaagggggagaccucucuuguuuaagacaacagaaggaaucaacaaaugcacccucauugccauggaccugggugaaaugugugaagacacugucacuuacaaauguccucuacugguuaacaccgaaccugaagacauugauugcuggugcaaucucacguccaccugggucauguacgggacaugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaacuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacuugacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaagagacaggaugugacagugcuaggaucucaggagggagcuaugcauucugcccucgccggagccacagaaguggauucuggugauggaaaucacauguuugcaggacaucucaagugcaaaguccguauggagaaauugagaauuaagggaaugucauacacgauguguucaggaaaguucucaauagacaaagagauggcagaaacacagcaugggacaacaguggugaaagucaaguacgaaggcgcuggagcuccguguaaaguccccauagagauaagagaugugaacaaggaaaaaguaguugggcgcaucaucucaucuacucccuuugcugagaauaccaacagcguaaccaacauagaauuagaacccccuuuuggggacagcuacauagugauagguguuggagauagugcauuaacacuccauugguucaggaaagggagcuccauuggcaagauguuugaguccacauacagaggugcaaaacgaauggccauuuuaggugaaacagcuugggauuuugguucuguugguggacuguucacaucacugggaaaggcuguacaccaaguuuuuggaaguguguauacaaccauguuuggaggggucucauggauaauuagaauccuaauuggguucuuaguacuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaauguuauguggaagcaaauaaccaacgagcuaaacuauguucucugggaaggaggacaugaccucacuguaguggcuggggacgugaaagggguguugacuaaaggcaagagagcacucacaccuccagugaaugaucugaaauauucauggaagacauggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugcugacauggguuauuggauagagagcucaaaaaaccagaccuggcagauagagaaagcaucccuuauugaagugaaaacaugucuguggcccaaaacucacacgcuauggagcaauggagugcuggaaagucagaugcucauuccaagaucauaugcaggcccuuuuucacagcacaauuaccgccagggcuaugccacgcaaaccgcgggcccauggcacuugggcaaauuggagauagacuuuggagaaugucccggaacaacagucacaauucaggaggauugugaccauagaggcccaucuuugaggaccaccacugcaucuggaaaacuggucacgcaguggugcugccgcuccugcacgaugccucccuuaagguucuugggagaagauggaugcugguacgggauggagauuaggcccuugagugaaaaagaagagaacauggucaaaucacagguaacagccggacaggguacaucagaaacuuuuucuauggggcugcuaugccugaccuuguucguggaagaaugcuuaaggagaagagucacuaggaaacacaugauauugguugugguaaucaccuucugugcuaucauccuaggaggucucacauggguggacuuacuacgagcccuuaucauguuaggggacacuaugucugguagaauaggaggacagauucaccuagccaucauggcaguguucaagaugucaccaggauaugugcuggguguguuuuuaaggaaacuuacuucaagagagacagcgcugaugguaauaggaauggccaugacaacgguguuuucaauuccacgugaccucauggaacucauugauggaauaucauugggguugauauuacuaaaaauaguaacacacuuugacaacacccaagugggaaccuuagcccuuucccugacuuucauaagaucaacaacaccauuagucauggcuuggaggaccaucaugguuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugagggcauaauggcuguggguuuggugagccucuuaggaagcgcccuccuaaagaaugauguuccuuuagcuggcccaaugguggcaggaggcuuacuucuagcggcuuacguaaugagugguagcucagcagaccugucacuagagaaggcugccaaugugcaaugggaugaaauggcggacauaacuggcucaagcccaaucauagaagugaagcaggaugaagauggcucuuucuccauacgagacgucgaggaaaccaacaugauaacccucuuggugaaacuggcgcugauaacaguaucaggucuuuaccccuuggcaauuccaguuacaauggcacuaugguauauuuggcaagugaaaacacaaagaucaggagcucugugggacguccccucacccgcugccauucagaaagccacacugucugaagggguguauaggaucaugcaaagaggguuguucgggaaaacucagguuggaguagggauacacauggaagguguauuccacacaauguggcacguaacaagaggaucagugaucugccaugagacagggagauuagagccaucuugggcugacguuaggaaugacaugauaucauacggugggggauggaggcucggagacaaaugggacaaagaagaagauguucagguccuagccauagaaccaggaaaaaauccaaaacauguucaaacgaaaccaggccuuuucaagacccuaacuggagaaauuggagcaguaacucuggauuucaaacccggaacgucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacauuuuucgaaagaaaagguuaacuauaauggacuuacaccccggagccggaaagacaaaaagaauucucccaucaauagucagagaagcuuugaaaaggaggcugcgaaccuugauuuuggcccccacaagagugguggcggccgagauggaagaggccuuacgcggacugccaauccguuaucagaccccagcugugaaaucagagcacacaggaagagagauuguagaccuuaugugucaugcaaccuucacaacgagacuuuugucaucaaccaggguuccaaauuauaaccucauagugauggaugaagcacauuuuacugacccuuguagugucgcagcuagaggauacauuucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacugugugguuuguucccagcauaaaagcuggaaaugacauugcaaauuguuugagaaagucgggaaagaaaguaauccaguugagcagaaaaaccuuugacacagaguauccaaagacgaaacucacggacugggauuuuguggucaccacagacauaucugaaaugggagccaauuucagagcugggagagugauagaccccaggagaugccucaagccaguuauccuaacagaugggccagagagaguuauucuagcagguccaauuccaguaacuccagcaagugccgcucagagaagagggcgaauagguaggaauccagcacaagaagaugaccaauauguuuucuccggagacccacuaaagaaugaugaagaucaugcucacuggacagaagcaaagaugcugcuugacaauaucuacacuccugaagggauaauuccaacauuguuugguccggaaagggaaaaaacucaagccauugauggagaguuucgccucagaggggaacaaaggaagacuuuuguggaauugaugaggagaggagaccuuccgguguggcugagcuacaagguagcuucugccgguauaucuuauaaagaccgagaauggugcuucacaggggaaaggaauaaccaaauuuuagaagaaaacauggagguugaaaucuggacuagagagggagaaaagaaaaaguuaaggccaaaaugguuagaugcacguguguacgcugaccccauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacagcagaaaaaggagggagggccuaccaacacgcccugaacgaacucccggagucacuggaaacacucaugcuuguagcccuacuaggugcuaugacagccgguaucuuccuguuuuucaugcaggggaaaggaauagggaaauugucaaugggucugauagccauagcuguggcuagcggcuugcucuggguagcagaaauucagccccaguggauagcagcuucaaucauacuggaguuuuuucuuauggugcuguugauaccagaaccagaaaaacaaaggaccccacaagacaaucaauugaucuacguuauauugaccauucucaccauuauuggucuuauagcagccaaugagauggggcugauugaaaaaacaaaaacggacuuuggguucuaccagguaaaaacagaaaccaccauucuggauguagauuugagaccagccucagcguggacacucuaugcaguggccaccacuauucugacucccaugcugagacacaccauagagaacacgucugccaaccuaucucuagcagccauugccaaccaagcagcuguccuaaugggacuuggaaaaggauggccgcuccacagaauggaccucggugugccgcugcuagcaaugggauguuauucucaagugaacccaacaaccuugacagcaucccuagucaugcuuuuaguucauuaugccauaauagguccaggauugcaggcaaaagccacaagagaggcccagaaaaggacagcugcugggaucaugaaaaaccccacuguggacgggauaacaguaauagaucuagaaccaauauccuaugacccaaaauuugaaaagcaauuagggcaagucaugcuacuaguucuguguguuggacaauuacuuuugaugagaacaacaugggcucucugcgaaguauugacucuggccacaggaccaaucaugaccuugugggagggcaacccaggaagguuuuggaacacaaccauagcuguauccacagccaacauuuuuagaggaagcuacuuggcgggagcuggacuagcuuuuucgcucauaaagaaugcacaaacuccuaggaggggaacugggacuacaggagagacacugggagagaaguggaagagacagcuaaacucauuagauagaaaagaguuugaagaguacaaaagaaguggaauacuagaaguggauaggacugaggccaagucugcccuaagagauggaucuaaaaucaagcaugcgguguccagagggucuaguaagaucagauggauuguugaaagaggaaugauaaaaccaaaaggaaaggucguagaucuugguugcgggaggggaggaugguccuauuacauggcgacacucaagaacgugacugaagugaaaggauauaccaaaggagguccaggacaugaagaaccaauccccauggccacuuaugguuggaauuuggucaaacuccauucagggguugauguguucuacaaacccacugagcagguggauacccugcucugugacauuggggagucauccucuaauccgacaauagaggaaggaagaacauugagagucuugaagaugguggagccauggcucucuucaaaaccugaguucugcaucaaaguccucaaccccuacaugccgacaguuauagaagagcuggagaaacugcagagaagacaugguggaagccucgucagaugcccguuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcgagaagagcacaaagaaaccuggcacuaugaccaggaaaacccauacagaaccugggcguaucauggaagcuaugaagcuccuucgacaggcucagcauccuccauggugaacgggguaguaaaacugcugacaaaaccuugggaugugauuccaauggugacucaguuggccaugacagacacaaccccuuuugggcaacaaagaguguucaaggagaagguggauaccagaacaccacaaccaaaacccggcacacgaaugauuaugaccacgacagccaauugguugugggcccuccucgggaagaagaaaagucccagacugugcacaagggaagaguucaucucaaaaguuaggucaaaugcagccauaggcgcagucuuucaggaagaacagggauggacaucagccagugaagccgugaaugacagccgguucugggaacugguugacaaagaaagggcucugcaccaggaaggaaaaugugaaucgugugucuacaacaugauggggaaacgugagaaaaaauuaggagaguuugguagggccaagggaagccgagcgaucugguacauguggcugggggcgcgguuccuggaauuugaagcccuggguuucuugaaugaagaucacugguucagcagagaaaacucauggaguggaguggaaggggaaggucuacacagauugggauacaucuuggaggacauagauaagaaggauggagaccugauauaugcugacgacacagcaggcugggacacgagaaucacugaagaugaccuuuuaaaugaagaacugaucacagaacagauggccccucaccacaagacccuagccaaagccauuuucaaacuaaccuaucaaaacaaaguggugaaaguucucagacccacaccaaaaggagcgguaauggacaucauauccaggaaagaccaaagagguaguggacagguuggaacauaugguuuaaacacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuggaugagagguuuagcaccucccuccucuucuugaaugacaugggaaaggugagaaaagacaucccgcagugggaaccauccaagggauggaaaaacuggcaagagguuccuuuuugcucccaccauuuccacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguauuuccauagaagggaccugcgccuagccuccauggccauaugcucagcaguuccaacagaaugguuuccaacaagcagaacaacauggucaauccacgcucaucaccaguggaugaccacugaagauaugcuuaaaguguggaacagaguguggauagaagauaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagccaugaaaagauacagcgcuccuuucgagagugaaggaguucuguaa

SEQ ID NO: 7860 - RNA, 9867 nt, Artificial Sequence
  derived and/or modified CDS sequence (wt) from DENV-4__JQ915088__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacaucgauugcuggugcaaucucacguccaccugggucauguacgggacgugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaauuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauuacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacucgacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaagagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguuggagauagugcauuaacacuccauugguucagaaaagggagcucuauuggcaagauguuugaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuugguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagagcacucacaccuccagugaaugaucugaaauauucauggaagacguggggaaaagcaaaaaucucuaccccagaagcaagaaauagcacauuuuuaauagacggaccagacaccuccgaaugccccaaugaacgaagagcauggaacuuuuuugagguagaagacuauggauuuggcauguucacgaccaacauauggaugaaauuccgagaaggaaguucagaagugugugaccauagauuaaugucggcggcaaucaaagaucagaaagcagugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuucuauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaaggaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucaugagaucaacaacaccauuagucauggcuuggaggaccaucauggcuguguucuuugugaucacacuuauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguagcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucuuuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguauuccacacaauguggcacgugacaagaggaucagugaucugccaugagacagggagauuagagccaucuugggcugacgucaggaaugacaugauaucauacggugggggauggaggcucggagacaaaugggauaaagaagaagauguucagguccuggccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguaguuaccaaaucaggugauuacgucagugccauaacgcaagccgaaagaauuggugagccagauuaugaaguagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaaggaaaaacugugugguuuguucccagcauaaaagccggaaaugacaucgcaaauuguuugagaaagucgggaaagagagugauccaguugagcagaaaaaccuuugacacagaguauccaaagacgaaacucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuacaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagggccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauggcuguggccaguggcuugcucuggguagcggaaauucagccccaguggauagcagcuucaaucauacuggaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacacgucugccaacuuaucucuagcagccauugccaaccaggcagcuguccuaaugggacuuggaaaaggauggccgcuccacagaauggaccucggugugccgcuguuagccaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagaaccaauauccuaugacccaaaauuugaaaagcaguuagggcaagucaugcuacuaguccuguguguuggacaauuacuuuugaugagaacaaccugggcucucugcgaaguauuaacuuuggccacaggaccaaucaugaccuugugggagggcaacccgggaagguuuuggaacacgaccauagcuguauccacagccaacauuuuuagaggaagcuaccuggcgggggcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauuccuauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguccucaaccccuacaugccgacaguuauagaagaguuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguagugaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagucgguucugggaacugguugacaaagaaagggcucugcaccaggaaggaaaaugugaaucguguguuuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacgucccgcaaugggaaccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaucaguggaugaccacugaagauaugcuuaaaguguggaacagaguguggauagaagacaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcucuccuuccgagagugaaggaguucuguaa

SEQ ID NO: 7861 - RNA, 9867 nt, Artificial Sequence
  derived and/or modified CDS sequence (wt) from DENV-4__JQ915086__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacauugauugcuggugcaaucucacguccaccugggucauguacgggacgugcacccagagcggagagcggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaacuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacuugacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaaaagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguuggagauagugcauuaacacuccauugguucagaaaagggagcucuauuggcaagauguuugaguccacauacagaggcgcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuugguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagaguacucacaccuccagugaaugaucugaaauauucauggaagacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuuccauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaagaaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucauaagaucaacaacaccauuagucauggcuuggaggaccaucauggcuguguucuucgugaucacacuuauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguggcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucucuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguauuccacacaauguggcacgugacaagaggaucagugaucugccaugagacagggagauuagagccaucuugggcugacguuaggaaugacaugauaucauacggugggggauggaggcucggagacaaaugggauaaagaagaagauguucagguccuagccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguaguuaccaaaucaggugauuacgucagugccauaacgcaagccgaaagaauuggugagccagauuaugaaguagaugaggacauuuuccgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaagggaaaacugugugguuuguucccagcauaaaagccggaaaugacaucgcaaauuguuugagaaagucgggaaagagagugauccaguugagcagaaaaaccuuugacacagaguauccaaagacgaagcucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuauaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagagccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuagaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacacgucugccaacuuaucucuagcagccauugccaaccaggcagcuguccuaaugggacuuggaaaaggauggccgcuccacagaauggaccucggugugccgcuguuagcuaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagagccaauauccuaugacccaaaauuugaaaagcaguuagggcaagucaugcuacuaguccuguguguuggacaauuacuuuugaugagaacaaccugggcucucugcgaaguauuaacuuuggccacaggaccaaucaugaccuugugggagggcaacccgggaagguuuuggaacacgaccauagcuguauccacagccaacauuuuuagaggaagcuaccuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauucccauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguucucaaccccuacaugccgacaguuauagaagaguuggagaaacuacagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagccgguucugggaacugguugacaaagaaagggcucugcaccaggaaggaaaaugugaaucgugugucuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacgucccgcaaugggaaccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaccaguggaugaccacugaagauaugcuuaaaguguggaacagaguguggauagaagacaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcgcuccuuccgagagugaaggaguucuguaa

SEQ ID NO: 7862 - RNA, 9867 nt, Artificial Sequence
  derived and/or modified CDS sequence (wt) from DENV-4__JQ915087__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugagaugugugaagacacugucacguauaaaugcccucuacugguuaacaccgaaccugaagacaucgauugcuggugcaaucucacguccaccugggucauguacgggacgugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaauuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugacuaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacucgacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaaaagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguaggagauagugcauuaacacuccauugguucagaaaagggagcucuauuggcaagauguuugaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuugguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagagcacucacaccuccagugaaugaucugaaauauucauggaagacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaggugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuucuauggggcugcuaugccugaccuuguucguggaagaaugcuugaggagaagagucacuaggaaacacaugauauugguugugguaaucaccuucugugcuauuaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaagaaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucauaagaucaacaacaccauuagucauggcuuggaggaccaucauggcuguguucuucgugaucacacuuauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguggcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucucuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaggguguauuccacacaauguggcacgugacaagaggaucagugaucugccaugagacagggagauuagagccaucuugggcugacgucaggaaugacaugauaucauacggugggggauggaggcucggagacaaaugggauaaagaagaagauguucagguccuagccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguaguuaccaaaucaggugauuacgucagugccauaacgcaagccgaaagaauuggugagccagauuaugaaguagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaagggaaaacugugugguuuguucccagcauaaaagccggaaaugacaucgcaaauuguuugagaaagucgggaaagagagugauccaguugagcagaaaaaccuuugacacagaguauccaaagacgaaacucacggauugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuacaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagggccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuggaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacacgucugccaacuuaucucuagcagccauugccaaccaggcagcuguccuaaugggacuuggaaaaggauggccgcuccacagaauggaccucggugugccgcuguuagcuaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagaaccaauauccuaugacccaaaauuugaaaagcaguuagggcaagucaugcuacuaguccuguguguuggacaauugcuuuugaugagaacaaccugggcucucugcgaaguauuaacuuuggccacaggaccaaucaugaccuugugggagggcaacccgggaagguuuuggaacacgaccauagcuguauccacagccaacauuuuuagaggaagcuaccuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauucccauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguucucaaccccuacaugccgacaguuauagaagaguuggagaaacuacagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagccgguucugggaacugguugacaaagaaagggcucugcaccaggaaggaaaaugugaaucgugugucuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacaguuugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauuuacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacgucccgcaaugggaaccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaccaguggaugaccacugaagacaugcuuaaaguguggaacagaguguggauagaagacaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcgcuccuuccgagagugaaggaguucuguaa

SEQ ID NO: 7863 - RNA, 9867 nt, Artificial Sequence
  derived and/or modified CDS sequence (wt) from DENV-4__JQ915089__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacauugauugcuggugcaaucucacguccaccugggucauguacgggacgugcacccagagcggagagcggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaacuguuuucuuuguccuaaugaugcuaguugccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacuugacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaaaagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguuggagauagugcauuaacacuccauugguucagaaaagggagcucuauuggcaagauguuugaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuugguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagaguacucacaccuccagugaaugaucugaaauauucauggaaaacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuuccauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaagaaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucauaagaucaacaacaccauuagucauggcuuggaggaccaucauggcuguguucuucgugaucacacuuauuccuuugugcaggacaagcugucuucaaaaacagucccauuggguagaaauaacagcacuuaucuuaggagcccaggcuuugccaguguaccuaaugacucucaugaaaggagccucaagcagaucuuggccucuuaaugaggguauaauggcuguggguuuggugagccucuuaggaagcgcccuccuaaagaaugauguuccuuuagcuggcccaaugguggcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucucuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguguuccacacaauguggcacgugacaagaggaucagugaucugccaugagacagggagauuagagccaucuugggcugacguuaggaaugacaugauaucauacggugggggauggaggcucggagacaaaugggauaaagaagaagauguucagguccuagccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguaguuaccaaaucaggugauuacgucagugccauaacgcaagccgaaagaauuggugagccagauuaugaaauagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaagggaaaacugugugguuuguucccagcauaaaagccggaaaugacaucgcaaauuguuugagaaagucgggaaagagagugauccaguugagcagaaaaaccuuugacacagaguauccaaagacgaagcucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacagaggaagacuuucguggaauugaugaggagaggagaccuuccgguguggcugagcuacaagguagcuucugcugguaucucuuauaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagagccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuagaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacacgucugccaacuuaucucuagcagccauugccaaccaggcagcuguccuaaugggacuuggaaaaggauggccgcuccacagaauggaccucggugugccgcuguuagcuaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagagccaauauccuaugacccaaaauuugaaaagcaguuagggcaagucaugcuacuaguccuguguguuggacaauuacuuuugaugagaacaaccugggcucucugcgaaguauuaacuuuggccacaggaccaaucaugaccuugugggagggcaacccgggaagguuuuggaacacgaccauagcuguauccacagccaacauuuuuagaggaagcuaccuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauucccauggcuacuuauggcuggaauuuggucaaacuccauucaggaguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguucucaaccccuacaugccgacaguuauagaagaguuggagaaacuacagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagccgguucugggaacugguugacaaagaaagggcucugcaccaggaaggaaaaugugaaucgugugucuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacgucccgcaaugggaaccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaccaguggaugaccacugaagauaugcuuaaaguguggaacagaguguggauagaagacaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcgcuccuuccgagagugaaggaguucuguaa

SEQ ID NO: 7864 - RNA, 9867 nt, Artificial Sequence
  derived and/or modified CDS sequence (wt) from DENV-4__JQ915082__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacaucgauugcuggugcaaucucacguccaccugggucauguacgggacgugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaauuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacucgacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaaaagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguaggagauagugcauuaacacuccauugguucagaaaagggagcucuauuggcaagauguuugaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuugguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagagcacucacaccuccagugaaugaucugaaauauucauggaagacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuucuauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaagaaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucauaagaucaacaacaccauuagucauggcuuggaggaccaucauggcuguguucuucgugaucacacuuauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguggcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucucuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguauuccacacaauguggcacgugacaagaggaucagugaucugccaugagacagggagauuagagccaucuugggcugacgucaggaaugacaugauaucauacggugggggauggaggcucggagacaaaugggauaaagaagaagauguucagguccuagccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaagguuauuggacucuauggaaauggaguagucaccaaaucaggugauuacguuagugccauaacgcaagccgaaagaauuggugagccagauuaugaaguagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaagggaaaacugugugguuuguucccagcauaaaagccggaaaugacaucgcaaauuguuugagaaagucgggaaagagagugauccaguugagcagaaaaaccuuugacacagaguauccaaagacgaaacucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuacaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagggccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuggaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacaugucugccaacuuaucucuagcagccauugccaaccaggcagcuguccuaaugggacuuggaaaaggauggccgcuccacagaauggaccucggugugccgcuguuagcuaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagaaccaauauccuaugacccaaaauuugaaaagcaguuagggcaagucaugcuacuaguccuguguguuggacaacuacuuuugaugagaacaaccugggcucucugcgaaguauuaacuuuggccacaggaccaaucauaaccuugugggagggcaacccgggaagguuuuggaacacgaccauagcuguauccacagccaacauuuuuagaggaagcuaccuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauucccauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguucucaaccccuacaugccgacaguuauagaagaguuggagaaacuacagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagccgguucugggaacugguugacaaagaaagggcucugcaccaggaaggaaaaugugaaucgugugucuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacgucccgcaaugggauccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaccaguggaugaccacugaagauaugcuuaaaguguggaacagaguguggauagaagacaaccccaacaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcgcuccuuccgagagugaaggaguucuguaa

SEQ ID NO: 7865 - RNA, 9867 nt, Artificial Sequence
  derived and/or modified CDS sequence (wt) from DENV-4__JQ915081__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacaucgauugcuggugcaaucucacguccaccugggucauguacgggacgugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaauuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauaacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacucgacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaaaagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguaggagauagugcauuaacacuccauugguucagaaaagggagcucuauuggcaagauguuugaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuugguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagagcacucacaccuccagugaaugaucugaaauauucauggaagacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuucuauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaagaaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucauaagaucaacaacaccauuagucauggcuuggaggaccaucauggcuguguucuucgugaucacacuuauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguggcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucucuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguauuccacacaauguggcacgugacaagaggaucagugaucugccaugagacagggagauuagagccaucuugggcugacgucaggaaugacaugauaucauacggugggggauggaggcucggagacaaaugggauaaagaagaagauguucagguccuagccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguagucaccaaaucaggugauuacguuagugccauaacgcaagccgaaagaauuggugagccagauuaugaaguagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaagggaaaacugugugguuuguucccagcauaaaagccggaaaugacaucgcaaauuguuugagaaagucgggaaagagagugauccaguugagcagaaaaaccuuugacacagaguauccaaagacgaaacucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuacaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagggccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuggaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacaugucugccaacuuaucucuagcagccauugccaaccaggcagcuguccuaaugggacuuggaaaaggauggccgcuccacagaauggaccucggugugccgcuguuagcuaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagaaccaauauccuaugacccaaaauuugaaaagcaguuagggcaagucaugcuacuaguccuguguguuggacaacuacuuuugaugagaacaaccugggcucucugcgaaguauuaacuuuggccacaggaccaaucauaaccuugugggagggcaacccgggaagguuuuggaacacgaccauagcuguauccacagccaacauuuuuagaggaagcuaccuggcgggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauucccauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguucucaaccccuacaugccgacaguuauagaagaguuggagaaacuacagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccauugaaacagaaaaaccagacaugacaaucauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagccgguucugggaacugguugacaaagaaagggcucugcaccaggaaggaaaaugugaaucgugugucuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacgucccgcaaugggauccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaccaguggaugaccacugaagauaugcuuaaaguguggaacagaguguggauagaagacaaccccaacaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcgcuccuuccgagagugaaggaguucuguaa

SEQ ID NO: 7866 - RNA, 9867 nt, Artificial Sequence
  derived and/or modified CDS sequence (wt) from DENV-4__JQ915084__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacaucgauugcuggugcaaucucacguccaccugggucauguacgggacgugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaauuguuuucuuuguccuaaugaugcuagucgccccauccuacggaaugcgaugcguagggguagggaacagagacuucguggaaggagucucggguggagcaugggucgaccuggugcuagaacauggaggaugcgucacaaccauggcccagggaaaaccaacccuggauuuugaacugaccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagaugugguagacagaggguggggcaauggcuguggcuuguuuggaaaaggaggaguugugacaugugcgaaguuuuuaugcucggggaagauuacaggcaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacucgacugugaacccaggucuggaauugauuucaaugagaugauccugaugaaaaugaaaaagaaaacguggcuugugcacaagcaaugguuuuuggaccuaccucuacccuggacagcaggagcagacacaucagaaguucauuggaauuacaaagagagaauggugacauucaagguuccucaugccaagagacaggaugugacagugcuaggaucucaggagggagcuaugcacucugcccucgccggagcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguuggagauagugcauuaacacuccauugguucagaaaagggagcucuauuggcaagauguuugaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugaucagaauccuaauuggguucuuaguauuguggauuggcacgaauucaagaaauacuucaauggcaaugacgugcauagcuguuggaggaaucacucuguuuuuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagagcacucacaccuccagugaaugaucugaaauauucauggaagacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguucacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucugggaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuucuauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaaggaaacuuacuucaagagagacagcgcuaaugguaauaggaauggccaugacaacgguguuuucaauuccacaugaccucauggaacucauugauggaauaucauuggggcugauauuacuaaaaauaguaacacacuuugauaacacccaagugggaaccuuagcccuuucccugacuuucaugagaucaacaacaccauuagucauggcuuggaggaccaucauggcuguguucuuugugaucacacuuauuccuuugugcaggacaagcugucuucaaaaacagucccauuggguagaaauaacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguagcaggaggcuuacuucuagcggcuuacguaaugaguggcagcucagcagaccugucacuagagaaggcugccaauguacagugggaugaaauggcggacauaacuggcucaagcccaaucauagaagugaagcaggaugaagauggcucuuucuccauacgggacgucgaggaaaccaacaugauaacccucuuggugaaacuggcgcugauaacaguaucaggucuuuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguauuccacacaauguggcacgugacaagaggaucagugaucugccaugagacagggagauuagagccaucuugggcugacgucaggaaugacaugauaucauacggugggggauggaggcucggagacaaaugggauaaagaagaagauguucagguccuggccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguaguuaccaaaucaggugauuacgucagugccauaacgcaagccgaaagaauuggugagccagauuaugaaguagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguugaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaaggaaaaacugugugguuuguucccagcauaaaagccggaaaugacaucgcaaauuguuugagaaagucgggaaagagagugauccaguugagcagaaaaaccuuugacacagaguauccaaagacgaaacucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuacaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagaucgccacuuugccaaccuaccuuuccucuaaggccaaacuagcccuugacaacauagucaugcuccacacaacagaaaaaggagggagggccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuggaguuuuuucuuauggugcuguugauaccagaaccagaaaaacaaaggaccccacaagacaaucaauugaucuacguuauauugacuauucucgccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacaauucugacucccaugcugagacacaccauagagaacacgucugccaacuuaucucuagcagccauugccaaccaggcagcuguccuaaugggacuuggaaaaggauggccgcuccacagaauggaccucggugugccgcuguuagccaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagaaccaauauccuaugacccaaaauuugaaaagcaguuagggcaagucaugcuacuaguccuguguguuggacaauuacuuuugaugagaacaaccugggcucucugcgaaguauuaacuuuggccacaggaccaaucaugaccuugugggagggcaacccgggaagguuuuggaacacgaccauagcuguauccacagccaacauuuuuagaggaagcuaccuggcgggggcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcggugucuagagggucuaguaagaucagauggauuguugaaagagggaugauaaagccaaaaggaaaggucguggaucuugguugcgggaggggaggaugguccuauuacauggcgacacucaagaacgugacugaagugaaaggguacacaaaaggaggcccaggacaugaagaaccaauuccuauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguccucaaccccuacaugccgacaguuauagaagaguuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaaucauugggagaaggcuucagagauugcaagaagagcacaaggaaaccuggcacuaugaccaggaaaauccauacagaaccugggcguaucauggaagcuacgaagcuccuucgacaggcucagcauccuccauggugaacggggugguaaaacugcugacaaaaccuugggaugugauuccaauggugacccaguuggccaugacagacacaaccccuuuugggcaacaaagaguguucaaggagaagguggauaccagaacaccacaaccaaaaauuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccagugaagcugugaaugacagccgguucugggaacugguugacaaagaaagggcucugcaccaggaaggaaaaugugaaucguguguuuauaacaugauggggaaacgugagaaaaaauuaggagaguuugguagggccaagggaagccgagcaaucugguacauguggcugggggcgcgguuccuggaauuugaagcccuggguuuuuugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcaaucaguggagaugauugcguggugaagccccuagaugagagguucagcaccucccuccucuucuugaaugacaugggaaaggugaggaaagacgucccgcaaugggaaccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaucaguggaugaccacugaagauaugcuuaaaguguggaacagaguguggauagaagacaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcucuccuuccgagagugaaggaguucuguaa

SEQ ID NO: 7867 - RNA, 9867 nt, Artificial Sequence
  derived and/or modified CDS sequence (wt) from DENV-4__KM190936__SS-prME
ucaacgauaacauugcugugcuugauucccaccguaauggcguuuuccuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaauuugguccaaauugagaaccuugaauacacagugguuguaacaguccacaauggagacacccaugcaguaggaaaugacacauccaaucauggaguuacagccaugauaacucccaggucaccaucgguggaagucaaauugccggacuauggagaacuaacacucgauugugaacccaggucuggaauugacuuuaaugagaugauucugaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucuuaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcguaucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggcuaugacgugcauagcuguuggaggaaucacucuguuucugggcuucacaguucaagcagacauggguuguguggugucauggagugggaaagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguucucugggaaggaggacaugaccucacuguaguggcuggggaugugaaggggguguugaccaaaggcaagagagcacucacacccccagugagugaucugaaauauucauggaagacauggggaaaagcaaaaaucuucaccccagaagcaagaaauagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaauuagagauagacuuuggagaaugccccggaacaacagucacaauucaggaggauugugaccauagaggcccaucuuugaggaccaccacugcaucuggaaaacuagucacgcaauggugcugccgcuccugcacgaugccucccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuaguuguggugaucacucuuugugcuaucauccugggaggccucacauggauggacuuacuacgagcccucaucauguugggggacacuaugucugguagaauaggaggacagauccaccuagccaucauggcaguguucaagaugucaccaggauacgugcuggguguguuuuuaaggaaacucacuucaagagagacagcacuaaugguaauaggaauggccaugacaacggugcuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaggaugaagauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggaguaguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuagcucccacgagagugguggcggccgagauggaagaggcccuacguggacugccaauccguuaucagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuucuagugucgcggcuagaggauacaucucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacaggggaaagaaauaaccaaauuuuagaagaaaacauggagguugaaauuuggacuagagagggagaaaagaaaaagcuaaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugauaacauagucaugcuccacacaacagaaagaggagggagggccuaucaacacgcccugaacgaacuuccggagucacuggaaacacucaugcuuguagcuuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuagaguuuuuucucaugguacuguugauaccggaaccagaaaaacaaaggaccccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuaugguuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaaccuggcauuaugaucaggaaaacccauacagaaccugggcguaucauggaagcuaugaagcuccuucgacaggcucugcauccuccauggugaacgggguaguaaaacugcuaacaaaacccugggaugugauuccaauggugacucaguuagccaugacagauacaaccccuuuugggcaacaaagaguguucaaagagaagguggauaccagaacaccacaaccaaaacccgguacacgaaugguuaugaccacgacagccaauuggcugugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugaaagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggagcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaguccauucgugggaagauauaccuuaccuagggaaaagagaggauuugugguguggaucccugauuggacuuucuuccagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7868 - RNA, 9867 nt, Artificial Sequence
  derived and/or modified CDS sequence (wt) from DENV-4__JQ915090__SS-prME
ucaacaaugacauugcuguguuugauucccaccguaauggcauuucaccugucaacaagagacggcgaaccccucaugauaguggcaaaacacgaaagggggagaccucucuuguucaagacaacagaaggaaucaacaaaugcacccucauugccauggaccugggugaaaugugugaagacacugucacguauaaaugcccucuacugguuaacaccgaaccugaagacaucgauugcuggugcaaucucacguccaccugggucauguacgggacgugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcuuacaugauugggcaaacaggaauccagcgaauuguuuucuuuguccuaaugaugcuagucgccccauccuacggaaugcgaugcguagggguagggaacagagacuucguggaaggagucucggguggagcaugggucgacuuggugcuagaacauggaggaugcgucacaaccauggcccagggaaaaccaacccuggauuuugaacuggccaagacaacagcuaaggaaguggcucuguugagaaccuauuguauugaagcuucgauaucaaacauaaccacagcaacaagauguccaacgcaaggagagccuuaucucaaagaggaacaagaccaacaguacauuugccggagagacgugguagacagaggguggggcaauggcuguggcuuguuuggaaaaggaggaguugugacaugugcgaaguuuuuaugcucggggaagauuacagguaaucugguccaaauugaaaaccuugaauacacgguaguugugacaguccacaauggagacacccaugcaguaggaaaugacacauccaaucauggagugacagccacgauaacucccaggucaccaucgguagaaguuaaauugccggacuauggagaacuaacacucgacugugaacccaggucuggaauugauuucaaugagaugauccugaugaaaaugaaaaagaaaacguggcuugugcacaagcaaugguuuuuggaccuaccucuaccuuggacagcaggagcagacacaucagaaguucauuggaauuacaaagagagaauggugacauucaagguuccucaugccaagagacaggaugugacagugcuaggaucucaggagggagcuaugcacucugcccucgccggggcaacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaguaugaaggcgcuggagcuccguguaaaauccccauagagauaagagaugugaacaaggagaaaguaguugggcgcaucaucucaucuaccccuuuugcugagaauaccaacagcguaaucaacauagaauuagaacccccuuuuggggacagcuacauagugauagguguuggagauagugcauuaacacuccauugguucagaaaagggagcucuauuggcaagauguucgaguccacauacagaggugcaaaacgaauggccauucuaggugaaacagcuugggauuuugguucuguugguggacuguuuacaucacugggaaaggcuguacaccaaguuuuuggaaguguguauacaaccauguuuggaggggucucauggaugauuagaauccuaauuggguucuuaguauuguggauuggcacgaauucaagaaauacuucaauggcaaugacgugcauagcuguuggaggaaucacucuguuucuagguuucacaguucaagcagacauggguuguguggugucauggaaugggaaggaacuaaaauguggaagcggaauuuuugugguugacaacgugcacacuuggacagaacaguacaaauuccaaccagaguccccagcgaggcuagcgucugcaauacugaaugcccacaaagauggggucuguggaaucagaucaaccacgaggcuggaaaauguuauguggaagcaaauaaccaacgagcuaaacuauguucucugggaaggaggacaugaccucacuguaguggcuggggacguaaaggggguguugaccaaaggcaagagagcacucacaccuccagugaaugaucugaaauauucauggaagacguggggaaaagcaaaaaucuuuaccccagaagcaagaaauagcacauuuuuaauagacggaccagacaccuccgaaugccccaaugaacgaagagcauggaacuuuuuugagguagaagacuauggauuuggcauguucacgaccaacauauggaugaaauuccgagaaggaaguucagaagugugugaccauagauuaaugucggcggcaaucaaagaucagaaagcugugcaugccgacauggguuauuggauagagagcucaaaaaaccagaccuggcagauagagaaagcaucccucauugaagugaaaacaugucuguggcccaaaacccacacacuguggagcaauggggugcuggaaagucagaugcucauuccaagaucauaugcaggcccuuuuucacagcacaauuaccgccagggcuaugccacgcaaaccgcgggcccauggcacuuaggcaaauuggagauagacuuuggagaaugccccggaacaacaguuaaaauucaggaagauugugaccauagaggcccaucuuugaggaccaccacugcaucuggaaaacugguuacgcaauggugcugccgcuccugcacgaugccucccuuaagguucuugggggaagacggauguugguaugggauggagauuaggcccuugagugaaaaagaagagaacauggucaaaucacagguaacagccggacaggguacaucagaaacuuuuucuauggggcugcuaugccugaccuuguucguggaagaaugcuugaggagaagagucacuaggaaacacaugauauugguugugguaaucaccuucugugcuaucaucuuaggaggucucacauggauggacuuacugcgagcccuuaucauguuaggggacacuaugucugguagaauaggaggacagauucaccuagccaucaugacaguguucaagaugucaccaggauaugugcuggguguguuuuuaaggaaacuuacuucaagagagacagcgcuaaugguaauaggaauggccaugacaacgguguuuucaauuccacaugaccucauggaacucauugauggaauaucauuggggcugauauuacuaaaaauagugacacacuuugauaacacccaagugggaaccuuagcccuuucccugacuuucaugagaucaacaacaccauuagucauggcuuggaggaccaucauggcuguguucuuugugaucacacuuauuccuuugugcaggacaagcugucuucaaaaacagucccauuggguagaaaugacagcacuuaucuuaggagcccaggcuuugccaguguaccuaaugacucucaugaaaggagccucaagaagaucuuggccucuuaaugaggguauaauggcuguggguuuggugagccucuuaggaagcgcccuccuaaagaaugauguuccuuuagcuggcccaaugguagcaggaggcuuacuucuagcggcuuacguaaugaguggcagcucagcagaccugucacuagagaaggcugccaauguacagugggaugaaauggcggacauaacuggcucaagcccaaucauagaagugaaacaggaugaagauggcucuuucuccauacgggacgucgaggaaaccaacaugauaacccucuuggugaaacuggcgcugauaacaguaucaggucuuuaccccuuggcaauuccagucacaauggcacuaugguauauuuggcaagugaaaacacaaagaucaggagcucugugggacguccccucgcccgcugccacucagaaagccacacugucugaagggguguauaggaucaugcaaagagggcuguuugggaaaacucagguuggaguagggauacacauggaagguguauuccacacaauguggcacgugacaagaggaucagugaucugccaugagacagggagauuagaaccaucuugggcugacgucaggagugacaugauaucauacggugggggauggaggcucggagacaaaugggauaaagaagaagauguucagguccuggccauagaaccaggaaaaaauccuagacauguccaaacgaaaccaggccuuuucaagacccuaacuggagaaauuggagcaguaacucuggauuucaaaccuggaacgucuggcucuccuaucaucaacaagaaagggaaaguuauuggacucuauggaaauggaguaguuaccaaaucaggugauuacgucagugccauaacgcaagccgaaagaauuggugagccagauuaugaaguagaugaggacauuuuucgaaagaaaagauuaacuauaauggacuuacaccccggagcuggaaagacaaaaagaauucucccaucaauagucagagaagcuuugaaaaggaggcugcgaaccuugauuuuggcucccacgagagugguggcggccgagauggaagaggcccuacgcggacugccaauccgcuaucagaccccagcugugaaaucagagcacacaggaagagagauuguagaccucaugugccaugcaaccuucacaacgagacuuuugucaucaaccaggguuccaaauuacaaccuuauagugauggaugaagcacauuuuacugacccuuguagugucgcggcuagaggauacaucucaaccaggguggaaaugggagaggcagcagcuaucuucaugacugcaaccccuccuggaucgauagaucccuucccccagagcaacagcccaauagaagacaucgagagggaaauccccgaaaggucauggaacacaggguucgacuggauaacagacuaccaaggaaaaacugugugguuuguucccagcauaaaagccggaaaugacaucgcaaauuguuugagaaagucgggaaagagagugauccaguugagcagaaaaaccuuugacacagaguauccaaagacgaaacucacggacugggauuuuguggucaccacagacauaucugaaaugggggccaauuuuagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaagaagaugaccaauauguuuucuccggagacccacuaaagaaugaugaagaucaugcucacuggacagaagcaaagauguugcuugacaauaucuacaccccugaagggauaauuccaacauuguuugguccggaaagggaaaaaacccaagccauugauggagaguuucgccucagaggggaacaaaggaagacuuucguggaauugaugaggagaggagaccuuccgguguggcugagcuacaagguagcuucugccgguaucucuuacaaagaccgagaauggugcuucacaggagaaaggaauaaccaaauuuuagaagaaaacauggagguugaaaucuggacuagagagggagaaaagaaaaagcuaaggccaaaaugguuagaugcacguguguacgcugaccccauggcuuugaaggauuucaaggaguucgccaguggaagaaagagcacaacucuugacauccuaacagagauugccacuuugccaaccuaccuuuccucuaaggccaaacuagcccuugacaacauagucaugcuccacacaacagaaaaaggagggagggccuaccaacacgcccugaacgaacucccggagucacuggaaacacucaugcucguagcccuacuaggugcuaugacagccgguaucuuccuguuuuuuaugcaggggaaaggaauagggaaauugucaaugggucugauagcuauagcuguggccaguggcuugcucuggguagcggaaauucagccccaguggauagcagcuucaaucauacuggaguuuuuucuuauggugcuguugauaccagaaccagaaaaacaaaggaccccacaagacaaucaauugaucuacguuauauugacuauucucaccauuauuggucucauagcagccaaugagauggggcugauugaaaaaacaaaaacggacuuuggguucuaccagguaaaaacagaaaccaccauucuugauguggauuugagaccagccucagcauggacacucuaugcaguggccaccacuauucugacucccaugcugagacacaccauagagaacaugucugccaacuuaucucuagcagccauugccaaccaggcagcuguccuaaugggacuuggaaaaggauggccgcuccacagaauggaccucggugugccgcuguuagccaugggauguuauucccaagugaacccaacaacccugacagcaucccuagucaugcuuuuaauccauuaugccauaauagguccaggauugcaggcaaaagccacaagagaggcccagaaaaggacagcugcugggaucaugaagaaccccacgguggacgggauaacaguaauagauuuagaaccaauauccuaugacccaaaauuugaaaagcaguuagggcaagucaugcuacuaguccuguguguuggacaauuacuuuugaugagaacaaccugggcucucugcgaaguauuaacuuuggccacaggaccaaucaugaccuugugggagggcaacccgggaagguuuuggaacacgaccauagcuguauccacagccaacauuuuuagaggaagcuaccuggcgggggcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauauuagaaguggauaggacugaggccaagucugcccuaagagauggaucuaaaaucaagcaugcgguguccagagggucuaguaagaucagauggauuguugaaagagggaugauaaagccaaaaggaaaggucguggaucuugguugcgggaggggaggaugguccuauuacauggcgacacucaagaacgugacugaagugaaaggguauacaaaaggaggcccaggacaugaagaaccaauucccauggcuacuuauggcuggaauuuggucaaacuccauucagggguugauguguucuacaaacccacugagcagguggacacccugcucugugacauuggggagucauccuccaauccaacaauagaggaaggaagaacauugagaaucuugaagaugguggagccauggcucucuucaaaaccugaguucugcaucaaaguccucaaccccuacaugccgacaguuauagaagaguuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauaggaaacccacuuaugagaaggacguagaucuuggggcaggaacgagaagugucuccacugaaacagaaaaaccagacaugacaauuauugggagaaggcuucagagauugcaagaagagcacaaagaaaccuggcacuaugaccaggaaaauccauacagaaccugggcguaucauggaagcuaugaagcuccuucgacaggcucagcauccuccauggugaacgggguaguaaaacugcugacaaaaccuugggaugugauuccaauggugacccaguuggccaugacagacacaaccccuuuugggcaacaaagaguguucaaggagaagguggauaccagaacaccacaaccaaaacuuggcacacgaaugauuaugaccacgacagccaauugguugugggcccuccucgggaagaagaaaagucccagacugugcacaagggaagaguucaucucaaaaguuaggucaaaugcagccauaggcgcagucuuucaagaagaacagggauggacaucagccauugaagcugugaaugacagccgguucugggaacugguugacaaagaaagggcucugcaccaggaaggaaaaugugaaucguguguuuauaacaugauggggaaacgugagaaaaaauuaggagaguuugguagggccaagggaagccgagcaaucugguacauguggcugggggcgcgguuccuggaauuugaagcccuggguuuucugaaugaagaucacugguuuagcagagaaaacucauggaguggaguggaaggagaaggccugcacagauugggauacaucuuggaggacauagacaagaaggauggagaccugauauaugcugacgacacagcaggcugggacacgagaaucacugaggaugaccuuuuaaaugaagaacugaucacagaacagauggccccucaccacaagacccuagccaaagccauuuucaaacuaaccuaucaaaacaaaguggugaaaguccucagacccacaccgaaaggagcgguaauggacauuauauccaggaaagaccaaagaggcaguggacagguuggaacauaugguuuaaauacauucacuaacauggaaguucaacucauccgccaaauggaagcugaaggagucaucacacaagacgacaugcagaacccaaaaggguugaaagaaagaguugagaaauggcugaaagaguguggcgucgacagguugaagaggauggcuaucaguggagaugauugcguggugaagccccuagaugagagguuuagcaccucccuccucuucuugaaugacaugggaaaggugaggaaagacgucccgcaaugggaaccauccaagggauggaaaaacuggcaagagguucccuuuugcucccaccauuuucacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguacuuccauagaagggaccugcgccuagccuccauggccauaugcucagcaguuccaacugaaugguuuccaacaagcagaacaacauggucaauccaugcucaacaucaguggaugaccacugaagauaugcuuaaaguguggaacagaguguggauagaagacaaccccaauaugacugacaagacuccaguccauucgugggaagacauaccuuaccuagggaaaagagaggaucugugguguggaucccugauuggacuuucuuccagagccaccugggcgaagaacauucacacggccauaacccaggucaggaaucugaucggaaaagaggaauacguggauuacaugccagucaugaaaagauacagcucuccuuccgagagugaaggaguucuguaa

SEQ ID NO: 7869 - RNA, 9867 nt, Artificial Sequence
  derived and/or modified CDS sequence (wt) from DENV-4__KJ160504__SS-prME
ucaacgauaacauugcugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccugaugaugcuggucgccccauccuacggaaugcgaugcguaggagugggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccguaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaaucugguccaaauugagaaccuugaguacacagugguuguaacaguccacaauggagacacccaugcaguaggaaaugacacauccaaucauggaguuacagccacgauaacucccaggucaccaucgguggaagucaaauugccggacuauggagaacuaacacucgauugugaacccaggucuggaauugacuuuaaugagaugauccuaaugaaaaugaaaaagaaaacauggcucgugcacaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucauccaccccuuuggcugagaauaccaacaguguaaccaacauagaauuagaaccccccuuuggggacagcuacauagugauagguguuggaaacagcgcauuaacacuccauugguucaggaaagggagcuccauuggcaagauguuugaguccacauacagaggugcaaaacgaauggccauucugggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguuggaggaaucacucuguuucugggcuucacaguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucucacuguaguggcuggggacgugaagggaguguugaccaaaggcaagagagcacucacacccccagugagugaucugaaauauucauggaagacauggggaaaagcaaaaaucuucaccccagaagcaagaaacagcacauuuuugauagauggaccagacaccucugaaugccccaaugaacgaagagcauggaacucucuugagguggaagauuauggauuuggcauguucacgacgaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacccaaacagugggcccauggcacuuaggcaaauuagagauagacuuuggagaaugccccggaacaacagucacaauucaggaggauugugaccauagaggcccaucuuugaggaccaccacugcaucuggaaaacuagucacgcaaugguguugccgcuccugcacgaugccucccuuaagguucuugggagaagaugggugcugguaugggauggagauuaggcccuugagugaaaaagaagagaacauggucaaaucacaggugacggccggacagggcacgucagaaacuuuuucuaugggucuguugugccugaccuuguuuguggaagaaugcuugaggagaagagucacuaggaaacacaugauauuaguuguggugaucacucuuugugcuaucauccugggaggccucacauggauggaccuacuacgagcccucaucauguugggggacacuaugucugguagaauaggaggacagauccaccuagccaucauggcaguguucaagaugucaccaggauacgugcuggguguguucuuaaggaaacucacuucaagagagacagcacuaaugguaauaggaauggccaugacaacgguacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuagggagcgcucuuuuaaagaaugaugucccuuuggcuggcccaaugguggcaggaggcuuacuucuggcggcuuacgugaugaguggcagcucagcagaucugucacuagagaaggccgccaaugugcagugggaugaaauggcagacauaacaggcucaagcccaaucauagaagugaagcaagaugaagauggcucuuucuccauacgggacgucgaggaaaccaauaugauaacccuuuuggugaaacuggcacugauaacagugucaggucucuaccccuuggcaauuccaaucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucauacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuggauuucaaacccggaacgucugguucucccaucaucaacaggaaaggaaaagucaucggacucuauggaaauggaguaguuaccaaaucaggugacuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauuuuagcucccacgagagugguggcggccgagauggaagaggcccuacguggacugccaauccguuaucagaccccagcugugaaaucagaacacacaggaagagagauuguagaccucaugugucacgcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccaccaggugcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaagucauccaguugagcaggaaaaccuuugguacagaguauccaaaaacgaaacucacggacugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaguaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacaggggaaagaaauaaccaaauuuuagaagaaaacauggagguugaaauuuggacuagagagggagaaaagaaaaaauugaggccaagaugguuagaugcacguguauacgcugaccccauggcuuugaaggauuucaaggaguuugccaguggaaggaagaguauaacucuagacauccuaacagagauugccaguuugccagcauaccuuuccucuagggccaagcucgcccuugauaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggauagcagaaauucaaccccaguggauagcggccucaaucauacuagaguuuuuucucaugguacuguugauaccagaaccagaaaaacaaaggaccccacaagacaaucaauugaucuaugucauauugaccguucucaccaucauuggucugauagcagccaacgagauggggcugauugaaaaaacaaaaacggacuuuggguucuaccagguaaaaacagaaaccaccauccucgauguggacuugagaccagcuucagcauggacgcucuaugcaguagccaccacaguuuugacucccaugcugagacacaccauagaaaacacgucggccaaccuaucucuagcagccaucgccaaccaggcagccguccuaauggggcuuggaaagggauggccgcuacacagaauggaccucggugugccgcuguuagcaaugggaugcuauucucaagugaacccaacaaccuugacagcauccuuagucaugcuuuuuguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuaguccugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaacuccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguuucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguuuuacaaacccacagagcaaguggacacccugcucugugauauuggggagucaucuucuaauccaacaauagaggagggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccuccauggugaacgggguggugaaacugcuaacaaaacccugggaugugauuccaauggugacucaguuagccaugacagauacaaccccuuuugggcaacaaagaguguucaaagagaagguggauaccagaacaccacaaccaaaaccaggcacacgaaugguuaugaccacgacagccaauuggcugugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacuccagauuuugggaacugguugacaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauauggcuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggggaugauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcagucccaacggaaugguuuccaacaagcagaacaacauggucaauccacgcucaucaccaguggaugaccacugaagacaugcucaaaguguggaacagaguguggauagaagacaacccuaauaugacugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7870 - RNA, 9867 nt, Artificial Sequence
  derived and/or modified CDS sequence (wt) from DENV-4__GU289913__SS-prME
ucaacgauaacauugcugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacauuugccggagagaugugguagacagaggguggggcaaugguuguggcuuguuuggaaaaggaggaguugugacaugugcgaaguuuucauguucggggaagauaacaggcaauuugguccaaauugagaaccuugaauacacagugguuguaacaguccacaauggagacacccaugcaguaggaaaugauacauccaaucauggaguuacagccaugauaacucccaggucaccaucgguggaagucaaauugccggacuauggagaacuaacacucgauugugaacccaggucuggaauugacuuuaaugagaugauucugaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcguaucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggcuaugacgugcauagcuguuggaggaaucacucuguuucugggcuucacaguucaagcagacauggguuguguggugucauggagugggaaagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguucucugggaaggaggacaugaccucacuguaguggcuggggaugugaaggggguguugaccaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaauuagagauagacuuuggagaaugccccggaacaacagucacaauucaggaggauugugaccauagaggcccaucuuugaggaccaccacugcaucuggaaaacuagucacgcaauggugcugccgcuccugcacgaugccucccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuaguuguggugaucacucuuugugcuaucauccugggaggccucacauggauggacuuacuacgagcccucaucauguugggggacacuaugucugguagaauaggaggacagauccaccuagccaucauggcaguguucaagaugucaccaggauacgugcuggguguguuuuuaaggaaacucacuucaagagagacagcacuaaugguaauaggaauggccaugacaacggugcuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaggaugaagauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggaguaguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaucagaccccagcugugaaaucagaacacacaggaagagagauuguagaccucaugugucaugcaaccuucacaacaagacuuuugucaucaaccaggguuccaaauuacaaccuuauagugauggaugaagcacauuucaccgauccuucuagugucgcggcuagaggauacaucucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacaggggaaagaaauaaccaaauauuagaagaaaacauggagguugaaauuuggacuagagagggagaaaagaaaaagcuaaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugauaacauagucaugcuccacacaacagaaagaggagggagggccuaucaacacgcccugaacgaacuuccggagucacuggaaacacucaugcuuguagcuuuacuaggugcuaugacagcagguauuuuccuguuuuucaugcaagggaaaggaauagggaaauugucaauggguuugauaaccauugcgguggcuaguggcuugcucuggguagcagaaauucaaccccaguggauagcggccucaaucauacuagaguuuuuucucaugguacuguugauaccagaaccagaaaaacaaaggaccccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcuuuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuucaguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccuaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggaugguccuauuacauggcgacacucaagaacgugacugaagugaaaggguauacaaaaggagguccaggacaugaagaaccgauucccauggcuacuuauggcuggaauuuggucaaacuucauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaaccuggcauuaugaucaggaaaacccauacagaaccugggcguaucauggaagcuaugaagcuccuucgacaggcucugcauccuccauggugaacgggguaguaaaacugcuaacaaaacccugggaugugauuccaauggugacucaguuagccaugacagauacaaccccuuuugggcaacaaagaguguucaaagagaagguggauaccagaacaccacaaccaaaacccgguacacgaaugguuaugaccacgacagccaauuggcugugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauauauccuggaggagauagacaagaaggauggagaccuaauguaugcugaugacacagcaggcugggacacaagaauuacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauauggcuugaacacauucaccaacauggaaguucaacucauccgccaaauggaagcugaaggagucaucacacaagaugacaugcagaacccaaaaggguugaaagaaagaguugagaaauggcugaaagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggauuugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaguccauucgugggaagauauaccuuaccuagggaaaagagaggauuugugguguggaucccugauuggacuuucuuccagagccaccugggcgaagaacauucacacggccauaacccaggucaggaaccugaucggaaaagaggaauacguggauuacaugccaguaaugaaaagauacagugcuccuucagagagugagggaguucuguaa

SEQ ID NO: 7871 - RNA, 9867 nt, Artificial Sequence
  derived and/or modified CDS sequence (wt) from DENV-4__KJ579243__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauugggugcuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcggucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcagagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacugggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7872 - RNA, 9867 nt, Artificial Sequence
  derived and/or modified CDS sequence (wt) from DENV-4__KJ579246__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaacuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacgcaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaauccauucgugggaagauauaccuuaccuagggaaaagagaggauuugugguguggaucccugauuggacuuucuucuagagccaccugggcgaagaacauucacacggccauaacucaggucaggaaucugauuggaaaagaggaauacguggauuauaugccaguaaugaaaagauacagugcuccuucagagagugaaggaguucuguaa

SEQ ID NO: 7873 - RNA, 9867 nt, Artificial Sequence
  derived and/or modified CDS sequence (wt) from DENV-4__KJ579248__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguuuaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacugugguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccaggaaacacaugauauuagcugugguaaucacucuuugugcuaucauccuggggggccucacauggauggacuugcuacgagcccucaucauguugggggacacuaugucuggcagaguaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccaauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauccacacggccauaacucaggucaggaaucugaucggaaaagaggaauacguggauuauaugucaguaaugaaaagauacagugcuccuucagagagugaaggaguucuguaa

SEQ ID NO: 7874 - RNA, 9867 nt, Artificial Sequence
  derived and/or modified CDS sequence (wt) from DENV-4__KJ579240__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacauguacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuguggauuggcacgaacucaaggaacacuucaauggccgugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacugugguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggcugcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaaugagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaccauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguacauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7875 - RNA, 9867 nt, Artificial Sequence
  derived and/or modified CDS sequence (wt) from DENV-4__KJ596658__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcugugggguugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacugggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucaugcuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacaucgugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7876 - RNA, 9867 nt, Artificial Sequence
  derived and/or modified CDS sequence (wt) from DENV-4__KJ596659__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuucguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaaucacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguucucaauugacaaagagauggcagaaacacagcaugggacaacaguggugaaagucaaguaugaaggugcuggagcuccgugcaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuucguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccguuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7877 - RNA, 9867 nt, Artificial Sequence
  derived and/or modified CDS sequence (wt) from DENV-4__KJ596661__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaauaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccucauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugucguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucacgccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauauacgauguguucaggaaaguuuucaauugacaaagagauggcagaaacacagcaugggacgacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagauuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuuaggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuauugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggauaccaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagccucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauagaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaagaaucccaaacauguccaaacgaaaccuggccuuuucaagacccuaacuggagaaauuggagcaguaacauuggauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaaccauaauggacuuacacccuggagcuggaaagacaaaaagaauucuuccaucaauagugagagaagccuuaaaaaggaggcugcggacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcaacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauugucugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaaaccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcgaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuuaaugagaacaacaugggcuuucugugaagucuugacuuuggcuacaggaccaaccuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcucugaaagauggguccaaaaucaagcaugcaguaucuagaggguccaguaagaucagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacucugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaauuuggcagagccaagggaagccgagcaaucugguacauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggcgaggaaagacauuccgcagugggaaccaucuaagggauggaagaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuucacagaagggaucugcguuuagccuccauggcuauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7878 - RNA, 9867 nt, Artificial Sequence
  derived and/or modified CDS sequence (wt) from DENV-4__KJ596663__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaccgggaauggugcuucacuggggaaagaaauaaccaaauuuuagaagaaaacauggagguugaaauuuggacuagagagggagaaaagaaaaaacugaggccaaaaugguuagaugcacguguauaugcugaccccauggcuuugaaggauuucaaggaguuugccaguggaaggaagagcauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagacccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7879 - RNA, 9867 nt, Artificial Sequence
  derived and/or modified CDS sequence (wt) from DENV-4__KJ596664__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacugugguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggaacuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7880 - RNA, 9867 nt, Artificial Sequence
  derived and/or modified CDS sequence (wt) from DENV-4__KJ596665__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcggucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacugggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaaaacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7881 - RNA, 9867 nt, Artificial Sequence
  derived and/or modified CDS sequence (wt) from DENV-4__KJ596668__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguugagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccagucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagagucccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguucuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguauggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7882 - RNA, 9867 nt, Artificial Sequence
  derived and/or modified CDS sequence (wt) from DENV-4__KJ596670__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucguccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagauuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguucgaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcauccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacggccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7883 - RNA, 9867 nt, Artificial Sequence
  derived and/or modified CDS sequence (wt) from DENV-4__KJ596671__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggagggcaugaucucacugugguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacgacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguagaaaugggagaggcagcagccaucuucaugaccgcaaccccucccggagcaacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaacacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggcuacgggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccucaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7884 - RNA, 9867 nt, Artificial Sequence
  derived and/or modified CDS sequence (wt) from DENV-4__KJ579241__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagauuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccgugcaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguacacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaacaguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugcgcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacaaugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuuuuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7885 - RNA, 9867 nt, Artificial Sequence
  derived and/or modified CDS sequence (wt) from DENV-4__KJ596672__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuacugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauugguaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguuccuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuucucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauagcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggagacuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccaguaucgcggcuagaggauacaucucgaccaggguagaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuuaaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccuuggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacuagucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggaccgaagccaaguccgcccugaaagauggguccaaaaucaagcaugcaguaucuagaggguccaguaagauuagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaauagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugucaguaaugaaaagauacagugcuccuucagagagugaaggaguucuguaa

SEQ ID NO: 7886 - RNA, 9867 nt, Artificial Sequence
  derived and/or modified CDS sequence (wt) from DENV-4__KJ579242__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaccaugggguuacagccacgauaacucccaggucaccaucgguugaagucaaacugccggacuauggagaacuaacacuugauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccgugcaaaguccccauagagauaagagauguaaacaaggagaaagugguugggcgcguuaucucagccaccccuuuggcugagaacaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguacacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagaaagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaacaguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugcgcuaucauccuggggggccucacauggauggacuugcuacgagcccucaucauauugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggccuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacaaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauucuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggauccauuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccugacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcaucccuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacugguuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagauuagauggaucguagagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacaaugagaguuuugaagaugguggagccauggcucucuucaaaaccugaauucugcaucaagguccuuaaccccuauaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagaaaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7887 - RNA, 9867 nt, Artificial Sequence
  derived and/or modified CDS sequence (wt) from DENV-4__GQ398256__SS-prME
ucaacaaugacauugcuguguuugauucccaccguaauggcguuucacuugucaacaagagauggcgaaccccucaugauaguggcaaaacacgaaagggggagaccucucuuguuuaagacaacagaaggaaucaacaaauguacccuuauugcuauggaccugggugaaaugugcgaagacacugucacguacaaguguccucuacuggucaacaccgaaccugaagacauugauugcuggugcaaucucacguccaccugggucauguacgggacaugcacccagaacggagaacggagacgagagaagcgcucaguagcuuuaacaccacauucaggaaugggauuggaaacaagagcugagacauggaugucaucggaaggggcuuggaaacaugcucagagaguagaaagcuggauacucagaaacccaggauucgcgcucuuggcaggauucauggcuuauaugauugggcaaacaggaauccagcgaacuguuuucuuuguccugaugaugcuagucgccccauccuacggaaugcgaugcguagggguagggaacagagacuuuguggaaggagucucggguggagcaugggucgacuuggugcuagaacauggaggaugcgucacaaccauggcccagggaaaaccaaccuuggauuuugaauugaccaagacaacagccaaggaaguggcucuguuaagaacuuauugcauugaagccucgauaucaaacauaaccacggcaacaagauguccaacgcaaggagagccuuaucucaaagaggagcaagaccaacaguacauuugccggagagacgugguagacagaggguggggcaauggcuguggcuuauuuggaaaaggaggaguugugacaugugcgaaguuuuuaugcucggggaagauaacaggcaaucugguccaaauugaaaaccuugaauacacaguagcaguaacaguccacaauggagacacccaugcaguaggaaaugacacauccagccauggagugacagccacgauaacuccuaggucaccaucgguagaaguuaaauugccggacuauggagaacuaacacuugauugcgaacccagguccggaauugauuuuaaugagaugauccugaugaaaaugaaaaagaaaacguggcuugugcauaagcaaugguuuuuagaccuaccucuaccauggacggcaggagcagacacaucagaaguucauuggaaucauaaagagagaauggugacguucaagguuccucaugccaagagacaggaugugacagugcuaggaucucaggagggagcuaugcauucugcccucgccggagccacagaaguggauucuggugauggaaaucacauguuugcaggacaucucaagugcaaaguccgcauggagaaauugagaauuaaaggaaugucauacacgauguguucaggaaaguucucaauugacaaagagauggcagaaacacagcauggaacaacaguggugaaagucaaguaugaaggcgcuggagcuccguguaaaguccccauagagauaagagaugugaacaaggaaaaaguggucgggcguaucaucucaucuaccccuuuugcugagaauaccaacagcguaaccaacauagaauuagaacccccuuuuggggacagcuacauagugauagguguuggagagagugcauuaacacuccauugguucagaaaagggagcuccauugguaagauguuugaguccacauacagaggugcaaaacgaauggccauucuaggugaaacagcuugggauuuugguucuguugguggacuguucacaucauugggaaaggcuguacaccagguuuuuggaaguguguauacaaccauguuuggaggggucucauggaugguuagaauccuaauuggguucuuaguauuguggauuggcacgaauucaagaaacacuucaauggcaaugacaugcauagcuguuggaggaaucacucuguuucuagguuucacaguucaagcagacauggguuguguggugucauggaaugggaaggaauugaaauguggaagcggaauuuuugugguugacaacgugcacacuuggacagaacaguacaaauuucaaccagaguccccagcgagacuagcgucugcaauauugaaugcccacaaagauggggucuguggaauuagaucaaccacgaggcuggaaaauguuauguggaagcaaauaaccaacgagcuaaacuauguucucugggaaggaggacaugaccucacuguaguggcuggggacgugaaggggguguuaaccaaaggcaagagagcacucacaccuccagugaaugaucuaaaauauucauggaagacaugggggaaagcaaaaaucuuuaccccagaagcaagaaauaguacguuuuuaauagacggaccagacaccuccgaaugccccaaugagcgaagagcauggaacuuuuuugagguagaagacuauggauuuggcauguuuacgaccaacauauggaugaaauuccgagaaggaaguucagaagugugugaccauagauuaaugucggcggcaaucaaagaucagaaagcugugcaugcugacauggguuauuggauagagagcucaaaaaaccagaccuggcagauagagaaagcaucccuuauugaagugaaaacaugucuguggcccaaaacccacacgcuguggagcaauggaguguuggaaagucagaugcucauuccaagaucauaugcaggccccuuuucacagcacaauuaccgucagggcuaugccacgcaaaccgugggcccauggcaccuaggcaaauuggagauagacuuuggagaaugccccgggacaacagucgcaauucgggaggauugugaucacagaggcccaucuuugagaaccaccacugcaucuggaaaacuggucacgcaauggugcugccgcuccugcacgaugccucccuuaagguucuugggagaagauggauguugguaugggauggagaucaggccuuugagugaaaaagaagagaacauggucaaaucacagguaacggccggacagggcacaucagaaacuuuuucuauggggcugcuaugccugaccuuguuuguggaagaaugcuugaggagaagagucacuaggaaacacaugauauugguugugguaaucaccuuuugugcuaucauccuaggaggucucacauggauggacuuacuacgagcccuuaucauguuaggggauacuaugucugguagaauaggaggacagauucaccuagccaucauggcaguguucaagaugucaccaggauaugugcuggguguguuuuuaaggaaacuuacuucaagagagacagcgcuaaugguaauaggaauggccaugacaacgguguuuucaaucccacaugaccucauggaacucauugauggaauaucauugggguugauauuacuaaaaauaguaacacauuuugauaacacccaagugggaacccuagcccuuuccuugacuuuuuuaagaucaacaauaccauuagucauggcuuggaggaccauuauggcuguguucuuuguggucacacucauuccuuugugcaggacaagcugucuucaaaaacagucccauuggguagaaauaacagcacucauccuaggagcccaggcuuugccaguguaccuaaugacucucaugaaaggagccucaaggagaucuuggccucuuaaugagggcauaauggcuguggguuuggugagccucuuaggaagcgcccucuugaagaaugauguuccuuuggcuggcccaaugguggcaggaggcuugcuucuagcggcuuacguaaugagugguagcucagcagaccugucacuagagaaagcugccaacgugcagugggaugaaauggcggacauaacuggcucaagcccaaucauagaagugaagcaggaugaagauggcucuuucuccauacgggacgucgaggaaaccaauaugauaacucucuuggugaaacuggcacugauaacaguaucaggucuuuaccccuuggcaauuccagucacaauggcauuaugguauauuuggcaagugaagacacaaagaucaggagcucugugggacguccccucacccgcugccacccagaaagccacacugucugaaggaguguauaggaucaugcaaagagggcuguuugggaaaacucagguuggaguaggaauacacauggaaggcguauuucacacaauguggcauguaacaaggggaucagugaucugccaugagacagggagauuagagccaucuugggcugacgucaggaacgacaugauaucauacggugggggauggaggcucggagacaaaugggacaaagaagaagauguucaggucuuagccauagaaccagggaaaaaucccaaacauguccaaacgaaaccuggccuuuucaagacccuaacuggagaaauuggagcaguaacucuggauuucaaacccggaacgucuggcucucccaucauuaauaagaaaggaaaaguuauuggacucuauggaaauggaguaguuaccaaaucaggugauuaugucagugccauaacgcaagccgagagaauuggugagccagauuaugaaguagaugaggacauuuuucgaaagaaaagauuaaccauaauggauuuacaccccggagcuggaaagacaaaaagaauccucccaucaauagucagagaggcuuuaaaaaggaggcugcgaacccugauuuuggcucccacgagagugguggcggccgagauggaagaggcccuacguggauugccaauccguuaucagacuccagcugugaaaucagagcacacaggaagagagauuguagaccucaugugucaugcaaccuucacaacaagacuuuugucaucaaccaggguuccaaauuauaaccucauagugauggaugaagcacauuucacugacccuugcagugucgcggcuagaggauacauuucaaccaggguggaaaugggagaggcagcagcuaucuucaugacugcaaccccuccuggagcgacagaucccuucccccagagcaacagcccaauagaagacaucgagagggaaauuccagagaggucauggaacacaggguucgacuggauaacagacuaccaagggaaaacugugugguuuguucccagcauaaaagcuggaaaugacauugcaaauuguuugagaaagucgggaaagagagugauccaguugagcaggaaaaccuuugacacagaguauccaaagacgaaacucacggacugggauuuuguggucaccacagacauaucugaaaugggggccaauuucagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaggaagaugaccaauauguuuucuccggagacccacuaaaaaaugaugaagaucaugcucacuggacagaagcaaagaugcugcuugacaauaucuacaccccugaagggauaauuccaacacuguuugguccggaaagggaaaaaacccaagccauugauggagaguuucgccucagaggggaacaaaggaagacuuuuguggaauuaaugaagagaggagaccuuccgguguggcugagcuacaagguagcuucugccgguaucucuuacaaagaucgagaauggugcuucacaggagaaaggaauaaccaaauuuuagaagaaaacauggagguugaaauuuggacuaaagagggagaaaagaaaaagcuaaggccaaaaugguuagaugcacguguguacgcugaucccauggcuuugaaggauuucaaggaguuugccaguggaagaaagagcauaacucucgacauccuaacagagauugccaguuugccaacuuaccuuuccucuaaggccaagcuggcccuugacaacauaguuaugcuccacacaacagaaaaaggagggagggccuaccaacacgcccugaacgaacucccggagucacuggaaacacucaugcuuguagcucuacuaggugcuaugacagccggcaucuuccuguuuuucaugcaggggaaaggaauaggaaaauugucaaugggucuaauagccauagccguggcuaguggcuugcucuggguagcagaaauucagccccaguggauagcagcuucaaucauacuggaguucuuucuuauggugcuguugauaccagaaccagaaaaacaaaggaccccacaagacaaucaauugaucuacgucauauugaccauucucaccaucaucggucuuauagcagccaaugagauggggcugauugaaaaaacaaaaacugacuuuggguuuuaccagguaaaaacagaaaccacuauucuugauguggauuugagaccagccucagcauggacacucuaugcgguagccaccaccauucugacucccaugcugagacacaccauagaaaacacgucugccaaccuaucuuuagcagccauugccaaccaagcagcuguccuaaugggacuuggaaaaggauggccgcuccacagaauggaccucggugugccgcuguuagcaauaggauguuauucucaagugaacccaacaacccugacagcauccuuagucaugcuuuuaguccauuaugccauaauagguccaggauugcaggcaaaagccacacgagaggcccagaaaaggacagcugcugggaucaugaagaacccuacgguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaagucuugacuuuggccacaggaccagccaugaccuugugggagggcaacccgggaagguuuuggaacacgaccauagcuguauccacagccaacauuuucagaggaagcuacuuggcaggagcuggacuagcuuuuucgcucauaaagaaugcacaaaccccuaggaggggaacugggaccacaggagagacacugggagagaaguggaagagacagcuaaacucauuagacagaaaagaguuugaagaguacaaaagaaguggaauacuagaaguggauaggacugaagccaagucugcccuaaaagauggaucuaaaaucaagcaugcgguguccagagggucuaguaagaucagauggauuguugaaagagggaugguaaagccaaaagggaaggucguggaucucgguugcgggaggggaggaugguccuauuacauggcgacacucaagaacgugacugaagugaaaggauauacaaaaggagguccaggacaugaggaaccaauccccauggcuacuuauggcuggaacuuggucaaacuccauucagggguugauguguuuuacaaacccacugagcagguggacaccuugcucugugacauuggggagucguccucuaauccgacaauagaggaaggaagaacauugagagucuugaagaugguggagccauggcucucuucaaaaccugaguucugcaucaaaguccucaaccccuauaugccaacaguuauagaagagcuggagaaacuccagagaagauaugguggaagccucgucagaugcccucuauccaggaauucuacccaugagauguauugggugucaggugcgucgggaaacaucgugaguucugugaacacaauaucaaagaugcuguugaacagguucacaacaaggcauaggaaacccacuuaugagaaggacguggaucuuggggcaggaacgagaagugucuccacugaaacagaaaaaccagacaugacaguuauugggagaaggcuucagagauugcaagaagagcacaaagaaaccuggcacuaugaccaggaaaacccauacagaaccugggcguaucauggaagcuaugaagcuccuucgacaggcucagcauccuccauggugaauggaauagugaaacugcugacaaaacccugggaugugauuccaauggugacccaguuggccaugacagacacaaccccuuuugggcaacaaagaguguucaaggagaagguggauaccagaacaccacaaccaaaacccggcacacgaaugauuaugaccacgacagccaauuggcugugggcucuccucgggaagaagaaaagucccagauuguguacaagggaagaguucaucucaaaaguuaggucaaaugcagccauaggcgcagucuuucaggaagaacagggauggacaucagccagugaagcugugaaugacagccgguucugggaacugguuaacaaagaaagggcucugcaccaggaaggaaaaugugaaucgugugucuauaacaugaugggaaaacgugagaaaaaauuaggagaguuugguagggccaagggaagccgagcaaucugguacauguggcugggggcgcgguuccuggaauuugaagcccuggguuucuugaaugaagaucacugguuuagcagagaaaacucauggaguggaguggaaggggaaggucugcacagauugggauauaucuuggaggauauagacaagcaggauggagaucuaauauaugcugacgacacagcaggcugggacacgagaaucacugaggaugaccuuuuaaaugaagaacugaucacagaacagauggccccccaccacaagacccuagccaaagccauuuucaaacuaaccuaucaaaacaaaguggugaaaguccucagacccacaccgaaaggagcggugauggacaucauauccaggaaagaccaaagagguaguggacagguuggaacauaugguuuaaacacauucacuaacauggaaguucaacucauccgccaaauggaagcugaaggagucaucacacaagacgacaugcagaacccaaaaggguugaaagaaagaguugagaaauggcugacagaguguggcgucgacagguugaagaggauggcaaucaguggagaugacugcguggugaaaccccuagaugagagguucagcgcuucccuccucuucuugaacgacaugggaaaggugaggaaagacaucccgcagugggaaccauccaagggauggaaaaacuggcaagaggucccuuuuugcucccaccauuuucauaagaucuuuaugaaagauggccgcucacuaguuguuccaugcagaaaccaggaugaacugauaggaagagccagaaucucgcagggggcuggauggagccuaagagaaacagccuguuugggcaaagcuuacgcccaaauguggucgcuuauguauuuccauagaagggaccugcguuuagccuccauggccauauguucagcaguuccaacggaaugguuuccaacaagcaggacaacauggucaauccacgcucaucaccaguggaugaccacugaagacaugcucaaaguguggaacaggguguggauagaagacaaccccaauaugacugacaagacuccaguccauucgugggaagacauaccuuaccuagggaaaagagaggauuugugguguggaucccugauuggacucucuuccagagccaccugggcgaagaacauucacacggccauaacccaggucaggaaucugaucggaaaagaggaauacguggauuacaugccagucaugaaaagauacagcgcuccuuccgaaagugaaggaguucuguaa

SEQ ID NO: 7888 - RNA, 9867 nt, Artificial Sequence
  derived and/or modified CDS sequence (wt) from DENV-4__KC333651__SS-prME
ucaacaaugacauugcuguguuugauucccaccguaauggcguuucaccugucaacaagagauggcgaaccccucaugauaguggcaaaacacgaaagggggagaccucucuuguuuaagacaacagaagggaucaacaaauguacccuuauugcuauggaccugggugaaaugugcgaagacacugucacguauaaguguccucuacugguuaacaccgaaccugaagacauugacugcuggugcaaucucacguccaccugggucauguacgggacaugcacccagaacggagaacggagacgagagaagcgcucaguagcuuuaacaccacauucaggaaugggauuggaaacaagagcugagacauggaugucaucggaaggggcuuggaaacaugcucagagaguagaaagcuggauacucagaaacccaggauucgcgcucuuggcaggauuuauggcuuacaugauugggcaaacaggaauccagcgaauuguuuucuuuguccugaugaugcuagucgccccauccuacggaaugcgaugcguagggguagggaacagagacuucguggaaggagucucggguggagcaugggucgacuuggugcuagaacauggaggaugcgucacaaccauggcccagggaaagccaaccuuggauuuugaauugacuaagacaacagccaaggaaguagcucuguuaagaaccuauugcauugaagccucgauaucaaacauaaccacggcaacaagauguccaacgcaaggagagccuuaucucaaagaggagcaagaccaacaguacauuugccggagagacgugguagacagaggauggggcaauggcuguggcuuauuuggaaaaggaggaguugugacaugugcaaaguuuuuaugcucggggaagauaacaggcaaucugguccaaauugaaaaccuugaauacacaguaguaguaacaguccacaauggagacacccaugcaguaggaaaugacacauccaaccauggagugacagccacaauaacuccuaggucaccaucgguugaaguuaaauugccggacuauggagaacuaacacucgauugcgagcccagguccggaauugauuuuaaugagaugauccugaugaagaugaaaaagaaaacguggcuugugcauaagcaaugguuuuuagaccuaccucuaccauggacggcaggagcagauacaucagaaguucauuggaaucauaaagagagaauggugacauucaagguuccucaugccaagagacaggaugugacagugcuaggaucucaggagggagcuaugcauucugcccucgccggagccacagaaguggauucuggugauggaaaucacauguuugcaggacaucucaagugcaaaguccgcauggagaaauugagaauuaaaggaaugucauacacgauguguucaggaaaguucucaauugacaaagagauggcagaaacacagcauggaaccacaguggugaaagucaaguaugaaggcgcuggagcuccguguaaaguucccauagagauaagagaugugaacaaggaaaaaguggucggacguaucaucucaucuaccccuuuugcugagaauaccaacagcguaaccaacauagaauuagaacccccuuuuggggacagcuacauagugauagguguuggagagagugcauuaacacuccauugguucagaaaagggagcuccauuggcaagauguuugaguccacauacagaggugcaaaacgaauggccauucuaggugaaacagcuugggauuuuggcucuguugguggacuguucacaucauugggaaaggccguacaccagguuuuuggaaguguguauacaacuauguuuggaggggucucauggaugguuagaauccuaauuggguucuuaguauuguggauuggcacaaauucaagaaacacuucaauggcaaugacgugcauagcuguuggaggaaucacucuguuucuggguuucacaguucaagcagacauggguuguguggugucauggaaugggaaggaauuaaaauguggaagcggaauuuuugugguugacaacguacacacuuggacagaacaguacaaauuucaaccagaguccccagcaagacuagcgucugcaauauugaaugcccacaaagauggggucuguggaauuagaucaaccacgaggcuggaaaauguuauguggaagcaaauaaccaaugagcuaaacuauguucucugggaaggaggacaugaccucacuguaguggcuggggaugugaaggggguguugaccaaaggcaagagagcacucacaccuccagugaaugaucugaaauauucauggaagacaugggggaaagcaaaaaucuuuaccccagaagcaagaaacaguacguuuuuaauagacggaccagacaccuccgaaugccccaaugagcgaagagcauggaacuuuuuugagguagaagacuauggauuuggcauguucacgaccaacauauggaugaaauuccgagaaggaaguucagaagugugugaccauagacuaaugucggcggcaaucaaagaucagaaagcugugcaugcugacauggguuauuggauagagagcucaaaaaaccagaccuggcagauagagaaagcaucccuuauugaagugaaaacaugucuguggcccaaaacccacacgcuguggagcaauggagugcuggaaagucagaugcucauuccaagaucauaugcaggccccuuuucacagcacaauuaccgucagggcuaugccacgcaaaccgugggcccauggcaccuaggcaaauuggagauagacuuuggagaaugccccgggacaacagucgcaauucgggaggauugugaccacagaggcccaucuuugagaaccaccacugcaucuggaaaacuggucacgcaauggugcugccgcuccugcacgaugccucccuuaagguucuugggagaagauggauguugguaugggauggagaucaggccucugagugaaaaagaagagaacauggucaaaucacagguaacggccggacagggcacaucagaaacuuuuucuauggggcuguuaugccugaccuuguuuguggaagaaugcuugaggagaagaguuacuaggaaacacaugauauugguugugguaaucaccuuuugcgcuaucauccuaggaggucucacauggauggacuuacuacgagcccuuaucauguuaggggauacuaugucugguagaauaggaggacagauccaccuagccaucauggcaguguuuaagaugucaccaggauacgugcuggguguguuuuuaaggaaacuuacuucaagagagacagcgcugaugguaauaggaauggccaugacaacgguguuuucaaucccacaugaccucauggaacucauugauggaauaucauugggguugauauuacuaaaaauaguaacacauuuugacaacacucaagugggaacccuagcccuuuccuugacuuuuuuaagaucaacaauaccauuagucauggcuuggaggaccauuauggcuguguucuuuguggucacacucauuccuuugugcaggacaagcugucuucaaaaacauucccacuggguagaaauaacagcacucauccuaggagcccaggcuuugccaguguaccuaaugacucucaugaagggagccucaaggagaucuuggccucucaaugagggcauaauggcuguagguuuggugagccucuuaggaagcgcccucuugaagaaugauguuccuuuggcuggcccaaugguggcaggaggcuugcuucuagcggcuuacguaaugagugguagcucagcagaccuguuacuagagaaagcugccaacgugcagugggaugaaauggcggacauaacuggcucaagcccaaucauagaagugaagcaggaugaagauggcucuuuuuccauacgggacgucgaggaaaccaauaugaugacucucuuggugaaacuggcacugauaacaguaucaggucuuuaccccuuggcaauuccagucacaauggcauuaugguauauuuggcaagugaagacacaaagaucaggagcucugugggacguccccucacccgcugccacccagaaagccacacugucugaaggaguguauaggauuaugcaaagagggcuguuugggaaaacucaaguuggaguaggaauacacauggaaggcguauuucacacaauguggcauguaacaaggggaucagugaucugccaugagacagggagauuagagccaucuugggcugacgucagaaacgacaugauaucauacggugggggauggaggcucggagacaaaugggacaaagaagaagauguucagguuuuagccauagaaccagggaaaaaucccaaacauguccaaacgaaaccuggccuuuucaagacccuaacuggagaaauuggagcaguaacucuggauuucaaacccggaacgucuggcucucccauuauuaacaagaaagggaaaguuauuggacucuauggaaauggagugguuaccaaaucaggugauuaugucagugccauaacgcaagccgagagaauuggugagccagauuaugaaguagaugaggacauuuuucgaaagaaaagauuaaccauaauggauuuacacccuggagcuggaaagacaaaaagaauccucccaucaauagucagagaggccuuaaaaaggaggcugcgaacccugauuuuagcucccacgagagugguggcggccgagauggaagaggcccuacguggauugccaauccguuaucagacuccagcugugaaaucagagcacacaggaagagagauuguagaccucaugugucaugcaaccuuuacaacaagacuuuugucaucaaccaggguuccuaauuauaaccucauagugauggaugaagcacauuucacugacccuugcagugucgcggcuagaggguacauuucaaccaggguggaaaugggagaggcagcagcuaucuucaugacugcaaccccuccuggagcgacagaucccuucccccagagcaacagcccaauagaagacaucgagagggaaauuccagaaaggucauggaacacaggguucgacuggauaacagacuaccaagggaaaacugugugguuuguucccagcauaaaagcuggaaaugacauugcaaauuguuugagaaagucgggaaagagagugauccaguugagcaggaaaaccuuugacacggaguauccaaagacgaaacucacggacugggauuuuguggucaccacagauauaucugaaaugggggccaauuucagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaggaagaugaccaauauguuuucuccggagacccacuaaaaaaugaugaagaucaugcucacuggacagaagcaaagaugcugcuugacaauaucuacaccccugaagggauaauuccaacacuguuugguccggaaagggaaaaaacccaagccaucgauggagaguuucgccucagaggggaacaaaggaagacuuuuguggaauuaaugaagagaggagaccuuccgguguggcugagcuacaagguagcuucugccgguaucuccuacaaagaucgagaauggugcuucacaggagaaaggaauaaccaaauuuuagaagaaaacauggagguugaaauuuggacuaaagagggagaaaagaaaaagcuaaggccaaaaugguuggaugcacguguguacgcugaucccauggcuuugaaggauuucaaggaguuugccaguggaagaaagagcauaacucucgacauccuaacagagauugccaguuugccaacuuaccuuuccucuaaggccaagcuggcucuugacaacauagucaugcuccacacaacagaaaaaggagggagggccuaccaacacgcccugaacgaacucccagaaucacuggaaacgcucaugcuuguagcucuacuaggugcuaugacagcaggcaucuuccuguuuuucaugcaggggaaaggaauaggaaaauugucaaugggucuaauagccauagcuguggcuaguggcuugcucuggguagcagaaauucagccccaguggauagcagcuucaaucauacuggaguucuuucuuauggugcuguugauaccagaaccagaaaaacaaaggaccccacaagacaaucaauugaucuacgucauauugaccauucucaccaucaucggucuuauagcagccaaugagauggggcugauugaaaaaacaaaaacugacuuuggguuuuaccagguaaaaacagaaacaacuauucuugauguggauuugagaccagccucagcauggacacuuuaugcgguagccaccaccauucugacucccaugcugagacacaccauagaaaacacgucugccaaccuaucucuagcagccauugccaaccaagcagcuguucuaaugggacuuggaaaaggauggccgcuccacagaauggaccucggugugccgcuguuagcaauaggauguuauucucaagugaacccaacaacccugacagcauccuuagucaugcuuuuaguccauuaugccauaauagguccaggauugcaggcaaaagccacacgagaggcccagaaaaggacagcugcugggaucaugaagaaccccacgguggacgggauaacaguaauagaucuagaaccaauauccuaugacccaaaauuugaaaagcaauuagggcaagucaugcuacuaguccugugugcuggacaauuacuuuugaugagaacaacaugggcucucugcgaagucuugacuuuggccacaggaccagccaugaccuugugggagggcaacccaggaagguuuuggaacacgaccauagcuguauccacagccaacauuuucagaggaagcuauuuggcaggagcuggacuagcuuuuucgcucauaaagaaugcacaaaccccuaggaggggaacugggaccacaggagagacacugggagagaaguggaagagacaguuaaacucauuagacagaaaagaguuugaagaguacaaaagaaguggaauacuagaaguggauaggacugaagccaagucugcccuaaaagauggaucuaaaaucaagcaugcgguguccagagggucuaguaagaucagauggauuguugaaagagggaugguuaagccgaaagggaaggucguggaucuugguugcgggaggggaggaugguccuauuacauggcgacacucaagaacgugacugaagugaaaggauauacaaaaggagguccaggacaugaggaaccaauccccauggcuacuuauggcuggaacuuggucaaacuccauucagggguugauguguuuuacaaacccacugagcagguggacaccuugcucugugacauuggggagucguccucuaauccgacaauagaggaaggaaggacauugagagucuugaagaugguagagccauggcucucuucaaaaccugaguucugcaucaaaguccucaaccccuacaugccaacaguuauagaagagcuggagaaacuccagagaagauauggcggaagccucgucagaugcccuuuauccaggaauuccacccaugagauguauugggugucaggugcgucgggaaacaucgugaguucugugaacacaauaucaaagaugcuguugaacagguucacaacaaggcauaggaaacccacuuaugagaaggacguggaucuuggggcaggaacgagaagugucuccacugaaacagaaaaaccagacaugacaguuauugggagaaggcuucagagauugcaagaagagcacaaagaaaccuggcacuaugaccaggaaaacccauacagaaccugggcguaucauggaagcuaugaagcuccuucgacaggcucagcauccuccauggugaacgggguaguaaaacugcugacaaaacccugggaugugauuccaauggugacccaguuggccaugacagacacaaccccuuuugggcaacaaagaguguucaaggagaagguggauaccagaacaccacaaccaaaacccggcacacgaaugauuaugaccacgacagccaauuggcugugggcucuccucgggaagaagaaaagucccagauuguguacaagggaagaguucaucucaaaaguuaggucaaaugcagccauaggcgcagucuuucaggaagaacaaggauggacaucagccagugaagcugugaaugacagccgguucugggaacugguugacaaagaaagggcucugcaccaggaaggaaaaugugaaucgugugucuauaacaugaugggaaagcgugagaaaaaauuaggagaguuugguagggccaagggaagccgagcaaucugguacauguggcuaggggcgcgguuccuggaauuugaagcccuggguuucuugaaugaagaucacugguuuagcagagaaaacucauggaguggaguggaaggggaaggucugcacagauugggauauaucuuggaggauauagacaagcaggaaggagaucuaauauaugcugacgacacagcaggcugggacacgagaaucacugaggaugaccuuuuaaaugaagaacugaucacagaacagauggccccccaucacaagacucuagccaaagccauuuucaaacuaaccuaucaaaacaaaguggugaaaguccucagacccacaccgaaaggagcggugauggacaucauauccaggaaagaccaaagagguaguggacagguuggaacauaugguuuaaacacauucacuaacauggaaguucaacucauccgccaaauggaagcugaaggagucaucacacaagacgacaugcagaacccaaaaggguugaaagaaagaguugagaaauggcugacagaguguggcgucgacagguugaagaggauggcaaucaguggagaugauugcguggugaagccccuagaugagagguucagcaccucccuccucuucuugaacgauaugggaaaggugaggaaagacaucccucagugggaaccauccaagggauggaaaaacuggcaagagguuccuuuuugcucccaccauuuucauaagaucuuuaugaaagauggccgcucacuaguuguuccaugcagaaaccaggaugaacugauaggaagagccagaaucucgcaaggggcuggauggagcuuaagagaaacagccuguuugggcaaagcuuacgcccaaauguggucgcuuauguauuuccauagaagggaccuacguuuagccuccauggccauauguucagcaguuccaacggaaugguuuccaacaagcaggacaacauggucaauccacgcucaucaccaguggaugaccacugaagacaugcucaaaguguggaacaggguguggauagaagacaaccccaauaugacugacaagacuccaguccauucgugggaagacauaccuuaccuagggaaaagagaggauuugugguguggaucccugauuggacucucuuccagagccaccugggcgaagaacauucacacggccauaacccaggucaggaaucugaucggaaaagaggacuacguggauuacaugccagucaugaaaagauacagcgcuccuuccgaaagugaaggaguucuguaa

SEQ ID NO: 7889 - RNA, 9867 nt, Artificial Sequence
  derived and/or modified CDS sequence (wt) from DENV-4__JN559740__SS-prME
ucaacgauaacauugcugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggacuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccucaauaucaaacauaacuacggcaacaagauguccaacgcaaggagagccuuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaauuugguccaaauugagaaccuugaauacacagugguuguaacaguccacaauggagacacccgugcaguaggaaaugacauauccaaucauggaguuacagccaugauaacucccaggucaccaucgguggaagucaaauugccggacuauggagaacuaacacucgauugugaacccaggucuggaauugacuuuaaugagaugauucugaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcguaucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggauuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggcuaugacgugcauagcuguuggaggaaucacucuguuucugggcuucacaguucaagcagacauggguuguguggugucauggagugggaaagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguucucugggaaggaggacaugaccucacuguaguggcuggggaugugaaggggguguugaccaaaggcaagagagcacucacacccccagugagugaucugaaauauucauggaagacauggggaaaagcaaaaaucuucaccccagaagcaagaaacagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaauuagagauagacuuuggagaaugccccggaacaacagucacaauucaggaggauugugaccauagaggcccaucuuugaggaccaccacugcaucuggaaaacuagucacgcaauggugcugccgcuccugcacgaugccucccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuaguuguggugaucacucuuugugcuaucauccugggaggccucacauggauggacuuacuacgagcccucaucauguugggggacacuaugucugguagaauaggaggacagauccaccuagccaucauggcaguguucaagaugucaccaggauacgugcuggguguguuuuuaaggaaacucacuucaagagagacagcacuaaugguaauaggaauggccaugacaacggugcuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaggaugaagauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccagggaaaaauccuaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggaguaguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaucagaccccagccgugaaaucagaacacacaggaagagagauuguagaccucaugugucaugcaaccuucacaacaagacuuuugucaucaaccaggguuccaaauuacaaccuuauagugauggaugaagcacauuucaccgauccuucuagugucgcggcuagaggauacaucucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugacacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacaggggaaagaaauaaccaaauuuuagaagaaaacauggagguugaaauuuggacuagagagggagaaaagaaaaagcuaaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugauaacauagucaugcuccacacaacagaaagaggagggagggccuaucaacacgcccugaacgaacuuccggagucacuggaaacacucaugcuuguagcuuuacuaggugcuaugacagcggguaucuuccuguuuuucaugcaagggaaaggaauagggaaauugucaauggguuugauaaccauugcgguggcuaguggcuugcucuggguagcagaaauucaaccccaguggauagcggccucaaucauacuagaguuuuuucucaugguacuguugauaccagaaccagaaaaacaaaggaccccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugaaaccagcuucagcauggacgcucuaugcaguagccaccacaauucugacucccaugcugagacacaccaucgaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaauaaccuugacagcauccuuagucaugcuuuuaguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaauguacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcagugucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggagggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaaccuggcauuaugaucaggaaaacccauacagaaccugggcguaucauggaagcuaugaagcuccuucgacaggcucugcauccuccauggugaacgggguaguaaaacugcuaacaaaacccugggaugugauuccaauggugacucaguuagccaugacagauacaaccccuuuugggcaacaaagaguguucaaagagaagguggauaccagaacaccacaaccaaaacccgguacacgaaugguuaugaccacgacagccaauuggcugugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauauggcuugaacacauucaccaacauggaaguucaacucauccgccaaauggaagcugaaggagucaucacacaagaugacaugcagaacccaaaaggguugaaagaaagaguugagaaauggcugaaagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaguccauucgugggaagauauaccuuaccuagggaaaagagaggauuugugguguggaucccugauuggacuuucuuccagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7890 - RNA, 9867 nt, Artificial Sequence
  derived and/or modified CDS sequence (wt) from DENV-4__JN559741__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguacaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggagcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccgcauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugggggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggacgugaaagggguguugaccaagggcaagagagcacucacacccccagcgagcgaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacaggcugaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggagagccagaugcuuauuccaaaaucauaugcaggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccagaaaacacaugauauuagcugugguaaucacucuuugugcuaucauccuggggggccucacauggauggacuugcuacgagcccucaucauguugggggacacuaugucuggcagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcugugcuguuuguggucacacucauuccuuuguguaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacguuccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucggaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacaucucgaccaggguggaaaugggagaggcagcagccaucuucaugaccgcaaccccucccggagcgacggaucccuuuccccagagcaacagcccaauagaagacaucgagagagagauuccggaaaggucauggaacacaggguucgacuggauaacagacuaccaagggaaaacugugugguuuguuccuagcauaaaagcuggaaaugacauugcaaauuguuugaggaagucgggaaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccaaagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagguaaaggaauagggaaauugucaauggguuugauaaccauugcgguggcuaguggcuugcucuggguagcagaaauucaaccccaguggauagcggccucaaucauacuggaguuuuuccucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaacacgucggccaaccuaucuuuagcagccauugccaaccaggcagccguccuaauggggcuuggaaaaggauggccacuccacagaauggaccucggugugccgcuguuagcaaugggaugcuauucucaagugaacccaacaaccuugacagcauccuuagucaugcuucuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccgcaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagaucagauggaucguugagagagggaugguaaagccaaaagggaaaguuguagaucuuggcugugggagaggaggauggucuuauuacauggcaacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauugagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaagaaaacccauacagaaccugggcguaucauggaagcuaugaagcuccuucgacaggcucugcguccuccauggugaacgggguggugaaacugcuaacaaaacccugggauguaauuccgauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuccaagaggaacagggauggacaucagccagugaagcugugaaugacagccgguuuugggaacugguugacaaagaaagggcccuucaccaagaagggaaaugugaaucgugugucuacaacaugaugggaaaacgugagaaaaaguuaggggaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuccaaaaugaggaacugaucacggaacagauggcuccccaccacaagauccuagccaaagccauuuucaaacuaaccuaccaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccuaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagcuugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaucaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuauaugccaguaaugaaaagauacagugcuccuucagagagugaaggaguucuguaa

SEQ ID NO: 7891 - RNA, 9867 nt, Artificial Sequence
  derived and/or modified CDS sequence (wt) from DENV-4__JQ513334__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugcgaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccauggaaguggcucuguuaagaaccuauuguauugaagccucaauaucaaacauaacuacggcaacaagauguccaacacaaggagagccuuaucugaaagaggaacaggaccaacaguacaucugccggagagaugugguagacagaggauggggcaauggcuguggcuuguuuggaaaaggaggaguugugacaugugcgaaguucucauguucggagaagauaacaggcaaucugguccaaauugagaaccuugaauacacagugguuguaacaguccacaacggagacacccaugcaguaggaaaugacacauccaaucauggaguuacagccacgauaacucccaggucaccaucgguagaagucgaacugccggacuauggagaacuaacacucgauugugaacccaggucuggaauugacuuuaaugaaaugaucuuaaugaaaaugaaaaagaagacauggcucgugcauaagcaaugguuuuuagaucugccucuuccaugggcagcaggagcagacacaucagagguucacuggaauuacaaagagagaauggugacauucaagguuccucaugccaagagacaggaugugacagugcucggaucucaggaaggagccaugcacucugcccucgcuggagccacagaaguggacuccggugauggaaaccacauguuugcaggacaucucaagugcaaaguccguauggagaaauugagaaucaaaggaaugucauacacgauguguucaggaaaguuuucaauugacaaagagauggcagaaacacagcaugggacaacaguggugaaagucaaguaugaaggugcuggagcuccgugcaaaguccccauagagauaagagauguaaacaaggaaaaagugguugggcgcguuaucucuuccaucccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccaccuacagaggugcaaaacgaguagccauucuaggugagacagcuugggauuuugguuccguugguggacuguucacaucacugggaaaggcuguucaccagguuuuuggaaguguguauacaaccauguuuggaggagucucauggaugguuagaaucuugauuggguuauuaguguuguggauuggcacgaauucaaggaacacuucaauggcgaugacgugcauagcuguuggaggaaucacucuguuuuugggcuucacaguucaagcggacauggguuguguggugucauggagugggagagaguugaaguguggaagcggaauuuuugugguugacaacgugcacacuuggacagaacaguacaaauuccaaccagaguccccagcgagacuggcgucugcaauauuaaaugcccacaaagauggggucuguggaauuagaucaaccacgaggcuggaaaaugucauguggaagcaaauaaccaaugagcuaaacuauguccucugggaaggaggacaugaucucacuguaguggcuggggaugugaaggggguguugaccaaaggcaagagagcacugacacccccagugagugaucugaaauauucauggaagacauggggaaaagcaaaaaucuucaccccugaagcaagaaacagcacauuuuugauagacggaccagacaccucugaaugccccaaugaacgaagagcauggaauucucuugagguggaagacuauggauuuggcauguucacgaccaacauauggaugaaauuccgagaaggaaguucagaagugugugaccacagguugaugucagcugcaauuaaagaucagaaagcugugcaugcugacauggguuauuggauagagagcucaaaaaaccagaccuggcagauagagaaagcaucacuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaagauugugaccauaggggcccaucuuugaggaccaccacugcaucuggaaaacuagucacgcaaugguguugccgcuccugcacgaugccccccuuaagguucuugggagaagauggaugcugguaugggauggagauuaggcccuugagugaaaaagaagagaacauggucaagucacagguggcggccggacagggcacaucagaaacuuuuucuaugggucuguugugccugaccuuguuuguggaagaaugcuugaggagaagggucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggcgcccaagcucugccaguguaccuaaugacucuuaugaaaggagccucaagaagaucuuggccucuuaacgagggcauaauggcuguggguuugguuagucucuuagggagcgcucuuuuaaagaaugaugucccuuuagcuggcccaaugguggcaggaggcuuacuucuggcggcuuacgugaugaguggcagcucagcagaucugucacuugagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucuguaccccuuggcaaucccagucacaaugaccuuaugguacauguggcaagugaaaacacaaagaucaggagcccugugggacgugcccucacccgcugccacucaaaaagccgcacugucugaaggaguguacaggaucaugcaaagaggguuauucgggaaaacucagguuggaguagggauacauauggaagguguauuucacacaauguggcauguuacaagaggaucagugaucugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggaguggucaccaaaucaggugauuacgugagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccuuaugugucaugcaaccuucacaacaagacuuuugucaucaaccaggguuccaaauuacaaccuuauagugauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacauugagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuuggaccggaaagggaaaaaacccaagccauugauggagaguuucgccucagaggggaacaaaggaagacuuuuguggaauuaaugaggagaggagaccuuccgguguggcugagcuauaagguagcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauaugcugaccccauggcuuugaaggauuucaaggaguuugccagcggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacucgaaacacucaugcuuguagccuuacuaggugcuaugacagcaggcaucuuccuguuuuucaugcaagggaaaggaauagggaaauugucaauggguuugauaaccauugcgguggcuaguggcuugcuuuggguagcagaaauucaaccccaguggauugcggccucaaucauacuggaguuuuuucucaugguacuguugauaccagaaccagaaaaacaaaggaccccacaagacaaucaauugaucuacgucauauuggccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcugcacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacagucgacgggauaacaguaauagaucuagaaccaauauccuaugacccaaaauuugaaaagcaauuagggcaggucaugcuacuagucuugugugcuggacaacuacucuugaugagaacaaccugggcuuucugugaagucuugacuuuggccacaggaccaaucuugaccuugugggagggcaacccgggaagguuuuggaacacgaccauagcuguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacaggaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacgcucaagaacgugacugaagugaaaggguauacaaaaggagguccaggacaugaagaaccgauucccauggcuacuuauggcuggaauuuggucaaacuccauucagggguugacgucuucuacaaacccacagagcaaguggacacccugcucugcgauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagauucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccucgauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaagucagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcucggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcgguaauggauaucauauccaggaaagaccaaagagguagcggacaaguuggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucacuccucuucuugaacgacaugggaaaggugaggaaagacauuccgcagugggaaccaucuaagggauggaaaaacuggcaagaggugccuuuuugcucccaucacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcgcagauguggucgcuuauguacuuccacagaagggaucugcguuuagccuccauggccaucugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauuccuuaccuagggaaaagagaggauuugugguguggaucccugauuggacuuucgucuagagccaccugggcgaagaacauucacacggccauaacucaggucaggaaccugaucggaaaagaggaauacgucgauuacaugccaguaaugaaaagauacagugcuccuucagagagugaaggaguucuguaa

SEQ ID NO: 7892 - RNA, 9867 nt, Artificial Sequence
  derived and/or modified CDS sequence (wt) from DENV-4__JQ513336__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugcgaggacacugucacguauaaaugcccccuacuggugaauaccgaaccugaagacauugauugcuggugcaaccuaacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauuguauugaagccucaauaucaaacauaacuacggcaacaagauguccaacacaaggagagccuuaucugaaagaggaacaggaccaacaguacaucugccggagagaugugguagacagaggauggggcaauggcuguggcuuguuuggaaaaggaggaguugugacaugugcgaaguucucauguucggagaagauaacaggcaaucugguccaaauugagaaccuugaauacacagugguuguuacaguccacaacggagacacccaugcaguaggaaaugacacauccaaucauggaguuacagccacgauaacucccaggucaccgucggucgaagucgaacugccggacuauggagaacuaacacucgauugugaacccagguccggaauugacuuuaaugaaaugaucuuaaugaaaaugaaaaagaaaacauggcucgugcauaagcaaugguuuuuggaucugccucuuccaugggcagcaggagcagacacaucagagguucacuggaauuacaaagagagaauggugacauucaagguuccucaugccaagagacaggaugugacagugcugggaucucaggagggagccaugcacucugcccucgcuggagccacagaaguggacuccggugauggaaaccacauguuugcaggacaucucaagugcaaaguccguauggagaaauugagaaucaaaggaaugucauacacgauguguucaggaaaguuuucaauugacaaagagauggcagaaacccagcaugggacaacaguggugaaagucaaguaugaaggugcuggagcuccgugcaaaguccccauagagauaagagauguaaacaaggaaaaagugguugggcgcguuaucucauccaucccuuuggcugagaauaccaacaguguaaccaacauagaauuagaaccccccuuuggggacagcuacauagugauagguguuggaaacagcgcauugacacuccauugguucaggaaagggaguuccauuggcaagauguuugaguccacauacagaggugcaaaacgaauggccauucuaggugagacagcuugggauuuugguuccguugguggacuguucacaucacucggaaaggcugugcaccagguuuuuggaaguguguauacaaccauguuuggaggagucucauggaugguuagaaucuugauuggguuauuaguguuguggauuggcacgaauucaaggaacacuucaauggcaaugacgugcauagcuguuggaggaaucacucuguuuuugggcuucacaguucaagcggacauggguuguguggugucauggagugggagagaguugaaguguggaagcggaauuuuugugguugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguccucugggaaggaggacaugaucucacuguaguggcuggggaugugaaggggguguugaccaaaggcaagagagcacugacacccccagugagugaucugaaauauucauggaagacauggggaaaagcaaaaauuuucaccccugaagcaagaaacagcacauuuuuaauagacggaccagacaccucugaaugccccaaugaacgaagagcauggaauucucuugagguggaagacuauggauuuggcauguucacgaccaacaucuggaugaaauuccgagaaggaaguucagaagugugugaccacagguugaugucagcugcaauuaaagaucagaaagcugugcaugcugacauggguuauuggauagagagcucaaaaaaccagaccuggcagauagagaaagcaucacuuauugaagugaaaacaugucuguggcccaagacccacacacuguggagcaauggagugcuggaaagccagaugcucauuccaaaaucauaugcgggcccuuuuucacagcacaauuaccgccagggcuaugccacgcaaaccgugggcccauggcacuuaggcaaacuagagauagacuuuggagaaugccccggaacaacagucacaauucaggaagauugugaccauaggggcccaucuuugagaaccaccacugcaucuggaaaacuagucacgcaaugguguugccgcuccuguacgaugccccccuuaagguucuugggagaagauggaugcugguaugggauggagauuaggcccuugagugaaaaagaagagaacauggucaagucacagguggcggccggacagggcacaucagaaacuuuuucuaugggucuguugugccugaccuuguuuguggaagaaugcuugaggagaagggucacuaggaaacacaugauauuagcugugguaaucacucuuugugcuaucauccugggaggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuugucgucacacucauuccuuugugcaggacaagcugucuucaaaaacagucucauugggucgaaauaacagcacucauccuaggcgcccaagcucugccaguguaccuaaugacucuuaugaaaggagccucaagaagaucuuggccucuuaacgagggcauaauggcuguggguuugguuagucucuuaggaagcgcucuuuuaaagaaugaugucccuuuagcuggcccaaugguggcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaagcuggcacugauaacagugucaggucuguaccccuuggcaaucccagucacaaugaccuuaugguacauguggcaagugaaaacacaaagaucaggagcccugugggacguccccucacccgcugccacucaaaaagccgcacugucugaaggaguguacaggaucaugcaaagaggguuauucgggaaaacucaggucggaguagggauacauauggaagguguauuucacacaauguggcauguuacaagaggaucagugauuugccacgagacugggagauuggagccaucuugggcugacgucaggaaugacaugauaucauacggugggggauggaggcuuggagacaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccaucaucaacaggaaaggaaaagucaucggacucuauggaaauggaguggucaccaaaucaggugauuacgucagugccauaacgcaagccgaaagaauuggagagccagauuaugaaguggaugaggauauuuuucgaaagaaaagauuaacuauaauggacuuacaccccggagcuggaaagacaaaaagaauucuuccaucaauagugagagaagccuuaaaaaggaggcugcgaacuuugauucuggcucccacgagagugguggcggccgagauggaagaggcccuacguggacugccaauccguuaccagaccccagcugugaaaucagaacacacaggaagagagauuguagaccuuaugugucaugcaaccuucacaacaagacuuuuguccucaaccaggguuccaaauuacaaccuuauagugauggaugaagcacauuucaccgauccuuccagugucgcggcuaggggauacauuucgaccaggguggaaaugggagaggcagcagccaucuucaugaccgcaaccccucccggagcgacagaucccuuuccccagagcaacagcccaauagaagacauugagagagagauuccggaaaggucauggaacacaggguucgacuggauaacagacuaccaagggaaaacugugugguuuguucccagcauaaaagcgggaaaugacauugcaaauuguuugagaaagucgggaaagaaaguuauccaguugaguaggaaaaccuuugauacagaauauccaaaaacgaaacucacggauugggacuuuguggucacuacagacauaucugaaaugggggcuaauuuuagagcugggagagugauagacccuagaagaugccucaagccaguuauccuaacagaugggccagagagagugauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuuggaccggaaagggaaaaaacccaagccauugauggagaguuucgccucagaggggaacaaaggaagacuuuuguggaauuaaugaggagaggagaccuuccgguguggcugagcuauaagguggcaucugcuggcauuucuuacaaagaucgggaauggugcuucacuggggaaagaaauaaccaaauuuuagaagaaaacauggagguugaaauuuggacuagagagggagaaaagaaaaaacugaggccaagaugguuagaugcacguguauaugcugaccccauggcuuugaaggauuucaaggaguuugccagcggaaggaagaguauaacucucgacauccuaacagagauugccagcuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcuuuggguagcagaaauucaaccccaguggaucgcggccucaaucauacuggaguuuuuucucaugguacuguugauaccagaaccagaaaaacaaaggaccccacaagacaaucaauugaucuacgucauauuggccauucucaccauuauuggucuaauagcagccaacgagauggggcugauagaaaaaacaaaaacggauuuuggguuuuaccagguaaaaacagaaaccaccauccucgauguggacuugagaccagcuucagcauggacgcucuaugcgguagccaccacaauucugacucccaugcugagacacaccauagaaaacacgucggccaaccuaucucuagcagccauugccaaccaggcagccguccuaauggggcuuggaaaaggauggccgcugcacagaauggaccucggugugccgcuauuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagaaccaauauccuaugacccaaaauuugaaaagcaauuagggcaggucaugcuacuagucuuaugugcuggacaacuacucuugaugagaacaaccugggcuuucugugaagucuugacuuuggccacaggaccaaucuugaccuugugggagggcaacccgggaagguuuuggaacacgaccauagcuguauccaccgccaacauuuucaggggaaguuacuuagcgggagcuggacuggcuuuuucacucauaaagaaugcacaaaccccuaggaggggaacugggaccacaggagagacacugggagagaaguggaagagacagcuaaacucauuagacaggaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacgcucaagaacgugacugaaguuaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcauccucgauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccucggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuucaccaggaagggaaaugugaaucgugugucuauaacaugaugggaaaacgugagaaaaaguuaggagaguuuggcagagccaagggaagccgagcaaucugguacauguggcucggagcgcgguuucuggaauuugaagcccuggguuuuuugaaugaagaucacugguuuggcagagaaaauucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuugccaaagccauuuucaaacuaaccuaucaaaacaaaguggugaaaguccucagacccacaccgagaggagcggugauggauaucauauccaggaaagaccaaagagguagcggacaaguaggaacauaugguuugaacacauucaccaacauggaaguucaacucauccgccaaauggaagcugaaggagucaucacacaagaugacaugcagaacccaaaaggguugaaagaaagaguugagaaauggcugagagaguguggugucgacagguuaaagaggauggcaaucaguggagacgauugcguggugaagccccuagaugagagguuuggcacuucccuccucuucuugaacgacaugggaaaggugaggaaagacauuccgcagugggaaccaucuaagggauggaaaaacuggcaagagguuccuuuuugcucccaucacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcucauguacuuccacagaagggaucugcguuuagccuccauggccaucugcucagcaguuccaacggaaugguuuccaacaagcagaacaacauggucaauccaugcucaucaccaauggaugaccacugaagacaugcucaaaguguggaacagaguguggauagaagacaaccccaauaugauugacaagacuccaguccauucgugggaagauauaccuuaccuggggaaaagagaggauuugugguguggaucccugauuggacuuucgucuagagccaccugggcgaagaacauucacacggccauaacucaggucaggaaccuuaucggaaaagaggaauacguggauuacaugccaguaaugaaaagauacagugcuccuucagagagugaaggaguucuguaa

SEQ ID NO: 7893 - RNA, 9867 nt, Artificial Sequence
  derived and/or modified CDS sequence (wt) from DENV-4__JQ513338__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaauaaaugcacucucauugccauggacuugggugaaaugugugaggacacugucacguauaaaugcccccuacuggucaauaccgaaccugaagacauugauuguuggugcaaccucacgucuaccugggucauguaugggacaugcacccagagcggagaacggagacgagagaagcgcucaguagcuuuaacaccacauucaggaaugggauuggagacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcucgucgccccauccuacggaaugcgaugcguaggaguaggaaacagagauuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggagcaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggaaacaccccugcaguaggaaaugacacauccaaucaugggguuacagccccgauaacucccaggucaccaucgguugaagucaaacugccggacuauggagaacuaacacucgauugugaacccaggucuggaauugacuucaaugagaugauucuaaugaaaaugaaaaagaaaacauggcucgugcauaagcaaugguuuuuggaucugccucuuccauggacaacaggagcugauacaucagagguucacuggaauuacaaagagagaauggugacauuuaagguuccucaugccaagagacaggaugugacagugcugggaucucaggaaggagccaugcauucugcccucgcuggagccacagaaguggacuccggugaugaaaaucacauguuugcaggacaucucaagugcaaaguccgcauggggaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaacaccaauaguguaaccaacauagaauuagaaccccccuuuggggacagguacauagugauagguguuggaaacagcgcacuaacacuccauugguucaggaaagggaguuccauuggcaagauguuugaauccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauucuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagccucugcaauauuaaaugcccacaaagauggggucuguggaauuagaucaaccacgaggcuggaaaauguuauguggaaacaaauaaccaaugagcuaaacuauguucucugggaaggaggacaugaucucacugucguggcuggggaugugaaagggguguugaccaaggggaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuacggauuuggcauguucacgaccaacauauggaugaaauuccgagaaggaaguucagaagugugugaucacagguuaaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccgugggcccauggcacuugggcaaacuagagauagacuuuggagaaugccccggaacaacaguuacaauucaggagaauugugaucauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacugauuuugcuaaaaauaguaacacaguuugacaacacccaagugggaaccuuagcucuuuccuuaacuuucauaagaucaacaaugucauuggucauggcuuggaggaccauuauggcuguguuguuuguggucacacucauuccuuugugcaggacaagcugucuucaaaaacagucucauuggguagaaauaacagcacuuauccuaggagcccaagcucugccaguguaccuaaugacucuuaugaaaggagccucaagaagaucuuggccucuuaacgaaggcauaauggcuguggguuugguuagucucuuaggaagugcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagucaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuuuaaacccggaacgucugguucccccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacucccaauccguuaccaaaccccagcugugaaaucagaacacacaggaagagagauuguagaccucaugugccaugcaaccuucacaacaagacuuuugucaucaaccagaguuccaaacuacaaccuuauuguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucggggaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcagguccuaucccagugacuccagcaagcgcugcccagagaagagggcgaauaggaaggaauccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccucccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuugcuaggugcuaugacagcagguaucuuccuguuuuucaugcaagggaaaggaauagggaaauugucaauggguuugauaaccauugcgguggcuaguggcuugcucuggguggcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuagugcauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucguguugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagguggauuguugagagagggaugguaaagccaaaagggaaaguuauagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggagggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacgucgaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaaggucgauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagcgagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaacgaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguuaaaagaaagaguugagaaauggcugagagaguguggugucgacagguuaaagaggauggcaauaaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcgcagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccagugcauucgugggaagauauaccuuaccuagggaaaagagaggauuugugguguggaucccugauuggacuuucuucuagagccaccugggcgaagaacauucacacggccauaacacaggucaggaaucugaucggaaaagaggaauacguggauuacaugccaguaaugaaaagauauagugcuccuucagagagugaaggaguucuguaa

SEQ ID NO: 7894 - RNA, 9867 nt, Artificial Sequence
  derived and/or modified CDS sequence (wt) from DENV-4__JQ513339__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaauaaaugcacucucauugccauggacuugggugaaaugugugaggacacugucacguauaaaugcccccuacuggucaauaccgaaccugaagacauugauuguuggugcaaccucacgucuaccugggucauguaugggacaugcacccagagcggagaacggagacgagagaagcgcucaguagcuuuaacaccacauucaggaaugggauuggagacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcucgucgccccauccuacggaaugcgaugcguaggaguaggaaacagagauuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacgguccacaauggagacacccaugcaguaggaaaugacacauccaaucaugggguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacgacaggagcagauacaucagagguucacuggaauuacaaagagagaauggcgaccuuuaagguuccucaugccaagagacaggaugugacacugcugggaucucaggaaggagccaugcauucugcccucgcuggagccacagaaguggacuccggugaugaaaaucacauguuugcaggacaucucaagugcaaaguccgcauggggaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguucucucagccaccccuuuggcugagaacaccaauaguguaaccaacauagaauuagaaccccccuuuggggacagcuacauagugauagguguuggaaacagcgcacuaacacuccauugguucacgaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagccucugcaauauuaaaugcccacaaagauggggucuguggaauuagaucaaccacgaggcuggaaaauguuauguggaaacaaauaaccaaugagcuaaacuauguucucugggaaggaggacaugaucucacugucguggcuggggaugugaaagggguguugaccaaggggaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuacggauuuggcauguucacgaccaacauauggaugaaauuccgagaaggaaguucagaagugugugaucacagguuaaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccgugggcccauggcacuugggcaaacuagagauagacuuuggagaaugccccggaacaacaguuacaauucaggagaauugugaucauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacugauuuugcuaaaaauaguaacacaguuugacaacacccaagugggaaccuuagcucuuuccuuaacuuucauaagaucaacaaugucauuggucauggcuuggaggaccauuauggcuguguuguuuguggucacacucauuccuuugugcaggacaagcugucuucaaaaacagucucauuggguagaaauaacagcacuuauccuaggagcccaagcucugccaguguaccuaaugacucuuaugaaaggagccucaagaagaucuuggccucuuaacgaaggcauaauggcuguggguuugguuagucucuuaggaagugcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagucaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuuuaaacccggaacgucugguucccccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacucccaauccguuaccaaaccccagcugugaaaucagaacacacaggaagagagauuguagaccucaugugccaugcaaccuucacaacaagacuuuugucaucaaccagaguuccaaacuacaaccuuauuguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucggggaagaaaguuauccaguugaguaggaaaaccuuugauacagaauauccaaaaacgaagcucacggacugggacuuuguggucacuacagacauaucugaaaugggggcuaacuuuagagcugggagagugauagacccuagaagaugccucaagccaguuauccuaacagaugggccagagagagucaucuuagcagguccuaucccagugacuccagcaagcgcugcccagagaagagggcgaauaggaaggaauccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccucccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuugcuaggugcuaugacagcagguaucuuccuguuuuucaugcaagggaaaggaauagggaaauugucaauggguuugauaaccauugcgguggcuaguggcuugcucuggguggcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuagugcauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucguguugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagguggauuguugagagagggaugguaaagccaaaagggaaaguuauagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggagggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacgucgaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaaggucgauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagcgagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaacgaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguuaaaagaaagaguugagaaauggcugagagaguguggugucgacagguuaaagaggauggcaauaaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcgcagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccagugcauucgugggaagauauaccuuaccuagggaaaagagaggauuugugguguggaucccugauuggacuuucuucuagagccaccugggcgaagaacauucacacggccauaacacaggucaggaaucugaucggaaaagaggaauacguggauuacaugccaguaaugaaaagauauagugcuccuucagagagugaaggaguucuguaa

SEQ ID NO: 7895 - RNA, 9867 nt, Artificial Sequence
  derived and/or modified CDS sequence (wt) from DENV-4__JQ513343__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaauaaaugcacucucauugccauggacuugggugaaaugugugaggacacugucacguauaaaugcccccuacuggucaauaccgaaccugaagacauugauugcuggugcaaccucacgucuaccugggugauguaugggacaugcacccagagcggagaacggagacgagagaagcgcucaguagcuuuaacaccacauucaggaaugggauuggagacaagagcugagacauggaugucaucggagggggcuuggaagcaugcucagagaguagagagcuggauacucagaaacccaggauuugcacucuuggcaggauuuauggcuuauaugauugggcaaacagggauccagcgaacugucuucuuuguccuaaugaugcuugucgccccauccuacggaaugcgaugcguaggaguaggaaacagagacuuuguggaaggagugucagguggagcauggguugaccuggugcuagaacauggaggaugcgucacaaccauggcccagggaaaaccaaccuuggauuuugaacugaccaagacaacagccaaggaaguggcucuguuaagaaccuauugcauugaagccuuaauaucuaacauaacuacggcaacaagauguccaacgcaaggagagccuuaucucaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucauggaguuacagccacgauaacucccaggucaccaucggucgaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggagaccuuuaagguuccucaugccaagagacaggaugugacacugcugggaucucaggaaggagccaugcauucugcccuggcuggagccacagaaguggacuccggugaugaaaaucacauguuugcaggacaucucaagugcaaaguccguauggaaaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagcgaccccuuuggcugagaauaccaauaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcugucgguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcuucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggaaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauuuggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucugauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccgucggcccauggcacuugggcaaacuagagauagacuuuggagaaugccccggaacaacaguuacaauucaggagaauugugaucauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagugaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacugacuucaagagagacagcacuaaugguaauaggaauggccaugacaacaacacuuucaauuccacaugaccucauggaacucauugauggaauaucacuaggacugauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacuuauccugggagcccaagcucugccaguguaccuaaugacucuuaugaaaggagccucaagaagaucuuggccucuuaacgaaggcauaauggcuguggguuugguuagucucuuaggaagugcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucuguaccccuuggcaauuccaaucacaaugaccuuaugguacauguggcaagugaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuuuaaacccggaacgucugguucccccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuccguggacuuccaauccguuaccaaaccccagcugugaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucggggaagaaagucauccaguugaguaggaaaaccuuugauacagaauauccaaaaacgaagcucacggacugggacuuuguggucacuacagacauaucugaaaugggggcuaacuuuagagcugggagggugauagacccuagaagaugccucaagccaguuauccuaacagaugggccagagagagucaucuuagcagguccuaucccagugacuccagcaagcgcugcccagagaagagggcgaauaggaaggaacccagcacaagaagacgaccaauacguuuucuccggagacccacuaaaaaaugaugaagaucaugcccacuggacagaagcaaagaugcuccuugacaauaucuacaccccagaagggaucauuccaacauuguuugguccggaaagggaaaaaacccaagcuauugauggagaguuucgccucagaggggaacaaaggaagacuuuugucgaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacucaggccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuccacacaacagaaagaggagggagggccuaucaacacgcccugaacgaacuuccggagucacuggaaacacucaugcuuguagccuugcuaggugcuaugacagcagguaucuuccuguuuuucaugcaagggaaaggaauagggaaauugucaauggguuugauaaccauugcgguggcuaguggcuugcucuggguggcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcucggaaaaggauggccacuccacagaauggaccucggugucccgcuguuagcaaugggaugcuauucucaagugaacccaacaaccuugacagcauccuuagucaugcuuuuagugcauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuggacagaaaagaguuugaagaguauaaaagaaguggaauacuagaaguggacaggacugaagccaagucugcccugaaagauggguccaaaaucaagcaugcaguaucuagaggguccaguaagaucagguggauuguugagagagggaugguaaagccaaaagggaaaguuauagaucuuggcugugggaggggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaagagggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugccuccuccauggugaacgggguggugaaacugcuaacaaaacccugggauguaauuccaauggugacucaguuagccaugacagauacaaccccuuuugggcaacaaagagucuucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccaucggcgcagucuuucaagaggaacagggauggacaucagccagugaagcugugaaugacagccgguuuugggaacuggucgacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaacgaagaucauugguuuggcagagaaaacucauggagugggguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguuaaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagaggucccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcgcagauguggucgcuuauguacuuccacagaagggaucugcguuuagccuccauggccauaugcucagcagucccaacggaaugguuuccaacaagcagaacaacauggucaauccaugcucaucaccaauggaugaccacugaagauaugcucaagguguggaacagaguguggauagaagacaaccccaauaugauugacaagacuccagugcauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucugagagugaaggaguucuguaa

SEQ ID NO: 7896 - RNA, 9867 nt, Artificial Sequence
  derived and/or modified CDS sequence (wt) from DENV-4__KT276273__SS-prME
ucaacgauaacauuguugugcuugauucccaccgugauggcguuucacuugucaacaagagauggcgaaccccucaugauaguggcaaaacaugaaagggggagaccucucuuguuuaagacaacagaggggaucaacaaaugcacucucauugcuauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuuaugaugcuggucgccccauccuacggaaugcgaugcguaggaguaggaaacagagacuuuguggaaggagucucagguggagcaugggucgaccuggugcuagaacauggaggaugcgucacaaccauggcccagggaagaccaaccuuggauuuugaacugacuaagacaacagcuaaggaaguggcucuguuaagaaccuauuguauugaagccucaauaucaaacauaaccacggcaacaagauguccaacgcaaggagagccuuaucugaaagaggaacaggaucaacaguacaucugccggagagaugugguagacagaggaugggguaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguagggaaugacacaucuaaucauggaguuacagccacgauaacucccaggucaccaucgguagaagucgaacugccggacuauggagaacuaacacucgauugugaaccuaggucuggaauugacuuuaaugagaugauccuaaugaaaaugaacaagaaaacauggcuugugcauaagcaaugguuuuuggaucuaccucuuccauggacagcaggagcagacacaucagagguucacuggaauaacaaagagagaauggugacauuuaagguuccucaugcuaagagacaggaugugacagugcugggaucucaggaaggagcuaugcauucagcccucgcuggagccacagaaguggacuccggugauggaaaucacauguuugcaggacaucucaagugcaaaguccguauggagaaauugagaaucaaaggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugauugggcgcguuaucucaucuaucccuuuggcugagaauaccaacagugugaccaacauagaauuagaaccccccuuuggggacagcuacauagugauagguguuggaaacagcgcauuaacacuccauugguuuaggaaagggaguuccauuggcaagauguucgaguccacauacagaggugcaaaacgaauggccauucuaggugagacggcuugggauuuugguucuguugguggacuguucacaucauugggaaaggcugugcaccagguuuuuggaaguguguacacaaccauguuuggaggagucucauggaugauuagaaucuuaauuggguucuuaguguuguggauuggcacgaacucaaggaacacuucaauggccaugacgugcauagcugucggaggaaucacucuguucuugggcuucacaguucaagcggacauggguuguguggugucauggagugggagagaguugaaauguggaagcggaauuuuugugauugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucuuacuguaguggcuggggaugugaaggggguguugaccaaaggcaagagagcacucacacccccagcaagugaucugaaauauucauggaagacauggggaaaagcaaaaaucuucaccccugaagcaagaaacagcacauuuuuaauagacggacccgauaccucugaaugccccaaugaacgaagagcauggaauucucuugagguggaagacuauggauuuggcauguucacgaccaacauauggaugaaauuccgagaaggaaguucagaaaugugugaccauagguuaaugucagcugcaauuaaagaucagaaagcugugcaugcugauauggguuauuggauagagagcucaaaaaaccagaccuggcagauagagaaagcaucucuuauugaagugaaaacaugucuauggcccaagacucacacacuguggagcaauggagugcuggaaagccagaugcucauuccaaaaucauaugcgggcccuuuuucacagcacaacuaccgucagggcuaugccacgcaaaucgcaggcccauggcacuuaggcaaacuagagauagacuuuggagaaugccccggaacaacagucacaauucaggaggauugugaccacagaggcccaucuuugaggaccaccacugcaucuggaaaguuagucacgcaaugguguugccgcuccugcacgaugccccccuuaagguucuugggagaagaugggugcugguaugggauggagauuaggcccuugagugaaaaagaagagaauauggucaaaucacagguggcggccggacagggcacaucagaaacuuuuucuaugggucuguugugccugaccuuguuuguggaagaaugcuugaggagaagagucacuaggaaacacaugauauuaguuguggugaucacuuuuugugcuaucauccugggaggccucacauggauggacuuacuacgagcccucaucauguugggggacacuaugucugguagaauaggaggacagauccacuuagccaucauggcaguguucaagaugucaccaggauacgugcuagguguguuuuuaaggaaacucacuucaagagagacagcacuaaugguaauaggaauggccaugacaacgguacuuucaauuccauaugaccuuauggaacucauugauggaauaucacuaggacuaauucugcuaaaaauaguaacacaguuugacaacacccaagugggaaccuuagcucuuuccuugacuuucauaagaucaacaaugccauuggucauggcuuggaggaccauuauggcuguguuguuuguggucacacucauuccuuugugcaggacaagcugucuucaaaaacagucucauuggguagaaauaacagcacucauucuaggagcccaagcucugccaguguaccuaaugacucuuaugaaaggagccucaagaagaucuuggccucucaacgagggcauaauggcugugggucugguuagucucuuaggaagcgcucuuuugaagaaugaugucccuuuagcaggcccaaugguagcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgagacgucgaggaaaccaauaugauaacccuuuuggugaagcuggcauugauaacagugucaggucucuaccccuuggcaauuccagucacaaugacccuaugguauauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacauauggaagguguguuccacacaauguggcauguuacaagaggaucagugaucugccaugagacugggagauuggagccaucuugggcugacgucaggaaugacaugauaucauacggugggggauggaggcuuggagacaaaugggacaaagaagaagacguucagguucucgcuauagaaccagggaaaaaucccaaacauguccaaacgaaaccaggccuuuucaagacccuaacuggagaaauuggagcaguaacauuagauuucaaacccggaacgucugguucucccaucaucaacaggaaaggaaaagucaucggacucuauggaaauggaguggucaccaaaucaggugauuacguuagugcuauaacgcaagccgaaagaauuggagagccagauuaugaaguggaugaggacauuuuucggaagaaaagauuaacuauaauggacuuacaccccggagcuggaaagacgaaaagaauucuuccaucaauagugagagaagcccuaaaaagaaggcugcgaacuuugauucuggcucccacgagagugguggcggccgaaauggaagaggcccuacguggacugccaauccguuaccagaccccagcugugaaaucagaacacacaggaagagagauuguagaccucaugugucaugcaaccuucacaacaagacuuuugucaucaacuaggguuccaaauuacaaccucauaguaauggacgaggcacauuucaccgauccuuccagugucgcggcuagaggauacauuucgaccaggguggaaaugggagaagcggcagccaucuucaugaccgcaaccccccccggagcgacagaucccuuuccccagagcaacagcccaauagaagacaucgagagagagauuccggaaaggucauggaacacaggguuugauuggauaacagacuaucaagggaaaacugugugguuuguucccagcauaaaagcuggaaaugauauugcaaauuguuugagaaagucgggaaagaaagucauucaguugaguaggaaaaccuuugacacagaauauccgaaaacgaaacucacggacugggacuuuguggucacuacagacauaucugaaaugggggcuaacuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccauuaaaaaaugaugaagaucaugcccacuggacagaagcaaagaugcugcuugacaauaucuacaccccagaagggaucauuccaacacuguuugguccggaaagggaaaaaacccaagccauugauggagaguuucgucucagaggggaacaaaggaagacuuuuguggaauugaugaggagaggagaccuuccaguguggcugagcuauaagguagcaucugcuggcauuucuuacaaagaucgggaauggugcuucacuggggaaagaaacaaucaaauuuuagaagaaaacauggagguugaaauuuggacuagagagggggaaaagaaaaaacugaggccaagaugguuagaugcacguguauaugcugaccccauggcuuugaaggauuucaaggaguuugccaguggaaggaagaguauuacucucgacauucuaacagagauugccaguuugccaacuuaucuuuccucuagggccaagcucgcccuugauaacauagucaugcuccacacaacagaaagaggagggagggccuaucaacaugcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauccaaccucaguggauagcggccucaaucauacuggaauuuuuucucaugguacuguugauaccagaaccagaaaaacaaaggaccccacaagacaaucaauugaucuacgucauauugaccauucucaccauuauaggucuaauagcagccaacgagauggggcugauagaaaaaacaaaaacggauuuuggguuuuaccagguaaagacagaaaccaccauccucgauguggauuugagaccagcuucggcauggacgcucuaugcaguagccaccacaauucugacucccaugcugagacacaccauagaaaacacaucggccaaccuaucuuuagcagccauugccaaccaggcagccguccuaauggggcuuggaaaaggauggccgcuccacagaauggaccucggugugccgcugcuggcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagagccaauauccuaugacccaaaauuugaaaagcaauuagggcaggucaugcuacuaguccugugugcuggacaacuacuccugaugagaacaacaugggcuuucugugaagucuugacuuuggccacaggaccaaucuugaccuugugggagggcaacccgggaagguuuuggaacacgaccauagccguauccacagccaacauuuucaggggaaguuacuuagcgggagcuggacuggcuuuuucacucauaaagaaugcacaaaccccuaggaggggaacugggaccacaggagagacacugggagagaaguggaagagacagcuaaacucauuagacagaaaagaguuugaagaauauaaaagaaguggaauacuggaaguggacaggacugaagcuaagucugcccugaaagaugggucuaaaaucaagcaugcagugucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauaccuauggcuacuuauggcuggaauuuggucaaacuccauucagggguugacguguucuauaaacccacagagcaaguggacacccugcucugugauauuggggagucaucuucuaauccaacaauagaggaaggaagaacauuaagaguucugaagaugguggagccauggcucucuucaaaaccugaauucugcauaaaaguccuuaaccccuacaugccaacagucauagaagagcuagagaaacugcagaggaaacauggugggaaccuugucagaugcccgcuguccaggaacuccacccaugagauguauugggugucaggagcgucgggaaacauugugagcucugugaacacaacaucaaagauguuguugaacagauucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaccauggaagcuaugaagcuccuucgacaggcucugcauccucuauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaauggucaugaccacgacagccaauuggcuaugggcccuccuuggaaagaagaagaaucccagacugugcacaaaggaagaguucaucucaaaaguuagagcaaacgcagccauaggcgcagucuuucaggaagaacagggauggacaucagccagugaagcugugaaugacagccgguuuugggagcugguugacaaagaaagggcccuucaccaggaagggaaaugugaaucgugugucuacaacaugaugggaaaacgugagaaaaaguuaggagaguuuggcagagccaagggaagccgagcaaucugguacauguggcugggagcucguuuucuggaauuugaagcccuggguuuuuugaaugaagaccacugguuuggcagagaaaauucauggaguggaguggaaggggaaggucugcacagauugggauacauccuggaggagauagacaagaaggauggagaccuaauguaugcugacgauacagcaggcugggacacaagaaucacugaggaugaccuucaaaaugaggaacugaucacggaacagauggcuccccaccauaagauccuagccaaagcuauuuucaaacuaaccuaucaaaacaaaguggugaaaguccucagacccacaccgagaggagcggugauggacaucauauccaggaaagaccaaagagguaguggacaaguuggaacauaugguuugaacacauucaccaacauggaaguccaacucauccgccaaauggaagcugaaggagucaucacacaagaugacaugcagaacccaaaaggguugaaagaaaggguugagaaauggcugagagaguguggugucgacagguuaaaaaggauggcaaucaguggagacgauugcguggugaagccccuagaugagagauuugccacuucccuccucuucuugaacgacaugggaaaggugaggaaagacauaccgcagugggaaccaucuaagggauggaaaaacuggcaagagguuccuuuuugcucccaccacuuucacaagaucuuuaugaaggauggccgcucacuaguaguuccauguagaaaccaggaugaacugauagggagagcuagaaucucgcagggggcuggauggagcuugaaagaaacagccugccuggccaaagcuuacgcccagauguggucgcuuauguacuuccacagaagggaucugcguuuggccuccauggccauaugcucagcaguuccaacggaaugguuuccaacaagcagaacaacauggucaauccacgcucaucaccaauggaugaccacugaagacaugcucaaaguguggaacagaguguggauagaggacaaccccaauaugauugacaagacuccaguccauucgugggaagacauaccuuaccuagggaaaagagaggauuuaugguguggauccuugauuggacuuucuucuagagccaccugggcgaagaacauucacacggccauaacucaggucaggaaccugaucggaaaagaggaauacauggauuacaugccaguaaugagaagauacagugcuccuucagagagugaaggaguucuguaa

SEQ ID NO: 7897 - RNA, 9867 nt, Artificial Sequence
  derived and/or modified CDS sequence (wt) from DENV-4__KU523872__SS-prME
ucaacaaugacauugcuguguuugauucccaccguaauggcguuucaccugucaacaagagacggcgaaccccucaugauaguggcaaaacacgaaagggggagaccucucuuguuuaagacaacagaaggaaucaacaaaugcacccucauugccauggaccugggugaaaugugugaagacacugucacguauaaauguccucuacugguuaacaccgaaccugaagacauugauugcugguguaaucucacguccaccugggucauguacgggacaugcacccagagcggagaacggaggcgagagaagcgcucaguagcuuuaacaccacauucaggaaugggauuggaaacaagagcugagacauggaugucaucggaaggggcuuggaaacaugcucagagaguggaaagcuggauacucagaaacccaggauucgcgcuccuggcaggauuuauggcucacaugauugggcaaacaggaauccagcgaacuguuuucuuuguccuaaugaugcuagucgccccauccuacggaaugcgaugcguagggguagggaacagagacuuuguggaaggagucucagguggagcgugggucgacuuggugcuagaacauggaggaugcgucacaacuauggcccagggaaaaccaaccuuggauuuugaacugaccaagacaacagcuaaggaaguggcucuguuaagaaccuauugcauugaagcuucgauaucaaacauaaccacggcaacaagauguccaacgcaaggagagccuuaucucaaagaggaacaagaccaacaguacauuugccggagagaugugguagauagaggguggggcaauggcuguggcuuguuuggaaaaggaggaguugugacaugugcgaaguuuucauguucggggaagauaacaggcaaucugguccaaauugaaaaccuugaauauacgguaguugugacaguccacaauggagacacccaugcaguaggaaaugacacauccaaucauggagugacagccacgauaacucccaggucaccaucgguagaagucaaauugccggacuauggagaacuaacacucgauugugaacccagguccggaauugacuucaaugagaugauccugaugaaaaugaaaaagaaaacguggcuugugcacaagcaaugguuuuuggaccuaccucuaccauggacagcaggagcagacacaucagaaguucauuggaauuauaaagagagaauggugacauucaaaguuccucacgccaagagacaggaugugacagugcuaggaucucaggagggagcuaugcauucugcccucgccggagccacagaaguggauucuggugauggaaaucacauguuugcaggacaucucaagugcaaaguccguauggagaaauugagaauuaagggaaugucauacacgauguguucaggaaaguucucaauugacaaagagauggcagaaacacagcaugggacaacaguggugaaagucaaauacgaaggcgcuggagcuccguguaaaguccccauagagauaagagaugugaacaaggaaaaaguaguugggcgcaucaucucaucuacccccuuugcugagaauaccaacaguguaaccaacauagaauuggaacccccuuuuggggacagcuacauagugauagguguuggagauagugcauuaacacuccauugguucaggaaagggagcuccauugguaagauguuugaguccacauacagaggugcaaaacgaauggccauuuuaggugaaacagcuugggauuuugguucuguugguggacuguucacaucacugggaaaggcuguacaccaaguuuuuggaaguguguauacaaccauguuuggaggggucucauggaugauuagaauccuaauuggguucuuaguacuguggauuggcacgaauucaagaaauacuucaauggcaaugacgugcauagcuguuggagggaucacucuguuucuagguuucacaguucaagcagacauggguuguguggugucauggaaugggaaggaacuaaaauguggaaauggaaucuuugugguugacaacgugcacacuuggacagaacaguacaaauuccaaccagaguccccagcgaggcuagcgucugcaauauugaaugcccacaaagauggggucuguggaaucagaucaaccacgaggcuggaaaauguuauguggaagcaaauaaccaacgagcuaaacuauguucucugggaaggaggacacgaccucacuguaguggcuggggacgugaaagggguguugaccaaaggcaagagagcacucacaccuccagugaaugaucugaaauauucauggaagacauggggaaaagcaaaaaucuuuaccccagaagcaagaaauagcacguuuuuaauagacggaccagacaccuccgaaugccccaaugaacgaagagcauggaacuuuuuugagguagaagacuauggauuuggcauguuuacgaccaacauauggaugaaauuccgagaaggaaguucagaagugugugaccauagguuaaugucagcggcaaucaaagaucagaaagcugugcaugcugacauggguuauuggauagagagcucaaaaaaccagaccuggcaaauagagaaagcaucccuuauugaagugaaaacaugucuguggcccaaaacccacacgcuguggagcaauggagugcuggaaagucagaugcucauuccaagaucauacgcaggcccuuuuucacagcacaauuaccgccagggcuaugccacgcaaaccgcgggcccauggcacuugggcaaguuggagauagacuuuggagaaugucccggaacaacagucacaauucaggaggauugugaccauagaggcccaucucugaggaccaccacugcaucuggaaaacuggucacgcaguggugcugccgcuccugcacgaugccucccuuaagguucuugggagaagauggaugcugguacgggauggagauuaggcccuugagugaaaaagaagagaacauggucaaaucacagguaacagccggacaggguacaucagagacuuuuucuauggggcugcuaugccugaccuuguucguggaagaaugcuuaaggagaagagucacuaggaaacacaugauauugguugugguaaucaccuuuugugcuaucauccuaggaggucucacauggguggauuuacuacgagcccuuaucauguuaggggacaccaugucugguagaauaggaggacagauucaccuagccaucauggcaguguucaagaugucaccaggauaugugcuggguguguuuuuaaggaaacucacuucaagagagacagcgcugaugguaauaggaauggccaugacaacgguguuuucaauuccacaugaccucauggaacucauugauggaauaucauugggauugauauuacuaaaaauaguaacacacuuugauaacacccaagugggaaccuuagcccuuuccuugacuuucauaagaucaacaacaccauuagucauggcuuggaggaccaucauggcuguguucuuuguggucacacucauuccuuugugcaggacaagcugucuucaaaaacagucccauuggguagaaauaacagcacuuaucuuaggagcccaggcuuugccaguguaccuaaugacucucaugaaaggagccucgagaagaucuuggccucuuaaugagggcauaauggcuguggguuuggugagccucuugggaagcgcccucuuaaagaaugauguuccuuuagcuggcccaaugguggcaggaggcuuacuucuagcggcuuacguaaugagugguagcucagcagaccugucacuagagaaggcugcuaaugugcaaugggaugaaauggcagacauaacuggcucaagcccagucauagaagugaagcaggaugaagauggcucuuucuccauacgagacgucgaggaaaccaacaugauaacccucuuggugaaacuggcgcugauaacaguaucaggucuuuaccccuuggcaauuccagucacaauggcaauaugguauauuuggcaagugaaaacacaaagaucaggagcucugugggacguccccucacccgcugccacucagaaagccacacugucugaagggguguauaggaucaugcaaagaggguuguucgggaaaacucagguuggaguagggauacacauggaagguguguuccacacaauguggcacguaacaagaggaucagugaucugccaugagacagggagauuagagccaucuugggcugacgucaggaaugacaugauaucauacggugggggauggaagcucggagacaaaugggacaaagaagaagauguucagguccuagccauagaaccaggaaaaaauccaaaacauguccaaacgaaaccaggccuuuucaagacccuaacuggagaaauuggagcaguaacucuggauuucaaacccggaacaucuggcucuccuaucauaaacaagaaagggaaaguuauuggacucuauggaaauggaguaguuaccaaaucaggugauuacgucagugccauaacgcaagccgaaagaauuggugagccagauuaugaaguggaugaggacauuuuucgaaagaaaagauugacuauaauggacuuacaccccggagccggaaagacaaaaagaauucucccgucaauagucagagaagcuuugaaaaggaggcugcgaaccuugauucuggcccccacgagagugguggcggccgagauggaagaggccuuacgcggacugccaauccguuaucagaccccagcugugaaaucagagcacacaggaagagagauuguagaccucaugugucaugcaaccuucacaacgagacuuuugucaucaaccaggguuccaaauuauaaccucauagugauggaugaagcacauuuuacugacccuuguagugucgcagcuagaggauacauuucaaccaggguggaaaugggagaggcagcagcuaucuucaugacugcaaccccuccuggaucgauagaucccuucccccagagcaacagcccaauagaagacaucgagagggaaaucccagaaaggucauggaacacaggguucgacuggauaacagacuaccaagggaaaacugugugguuuguucccagcauaaaagcuggaaaugacauugcaaauuguuugagaaagucgggaaagagaguaauccaguugagcagaaaaaccuuugacacagaguauccaaagacgaaacucacggacugggauuuuguggucaccacagacauaucugaaaugggagccaauuucagagcugggagagugauagacccuaggagaugccucaagccaguuauccuaacagaugggccagagagaguuauucuagcagguccaauuccaguaacuccagcaagugccgcucagagaagagggcgaauagguaggaauccagcacaagaagaugaucaauauguuuucuccggagacccacuaaggaaugaugaagaucaugcucacuggacagaagcaaagaugcugcuugacaauaucuacacuccugaaggaauaauuccaacauuguuugguccggaaagggaaaaaacccaagccauugauggagaguuucgccucagaggggaacaaaggaagacuuuuguggaauugaugaggagaggagaccuuccgguguggcugagcuacaagguagcuucugccgguauaucuuauaaagaccgagaauggugcuucacaggggaaaggaauaaccaaauuuuagaagaaaacauggagguugaaaucuggacuagagagggagaaaagaaaaagcuaaggccaaaaugguuagaugcacguguguacgcugacccuauggcuuugaaggauuucaaggaguuugccaguggaagaaagagcauaacucuugacauccuaacagagauugccacuuugccaacuuaccuuuccucuaaggccaagcuagcccuugacaacauagucaugcuccacacaacagaaaaaggggggagggccuaccaacacgcccugaacgaacucccggagucacuggaaacacucaugcuuguagcccuacuaggugcuaugacagccgguaucuuccuguuuuucaugcaggggaaagggauagggaaauugucaaugggucugauagccauagcuguggcuaguggcuugcucuggguagcagaaauucagccccaguggauagcagcuucaaucauacuggaguuuuuucuuauggugcuguugauaccagaaccagaaaaacagaggaccccacaagacaaucaauugaucuacguuauauugaccauucucaccauuauuggucuuguagcagccaaugagauggggcugauugaaaaaacaaaaacggacuuuggguucuaccagguaaaaacagaaaccaccauucuggauguggauuugagaccagccucagcguggacacucuaugcaguggccaccacuauucugacuccuaugcugagacacaccauagagaacacgucagccaaccugucucuagcagccauugccaaccaagcagcuguccuaaugggacuuggaaaaggauggccgcuccacagaauggaccucggugugccgcugcuagcaauaggauguuauucucaagugaacccaacaaccuugacagcaucccuagucaugcuuuuaguucauuaugccauaauagguccaggauugcaggcaaaagccacaagagaggcccagaaaaggacagccgcugggaucaugaaaaaccccacuguggacgggauaacaguaauagaucuagaaccaauauccuaugacccaaaauuugaaaagcaauuagggcaagucaugcuacuaguccuguguguuggacaauuacuuuugaugagaacaacaugggcucucugcgaaguauugacucuggccacaggaccaaucaugaccuugugggagggcaacccaggaagguuuuggaauacaaccauagcuguauccacagccaacauuuuuagaggaagcuacuuggcgggagcuggacuagcuuuuucgcucauaaagaaugcacaaacuccuaggaggggaacugggaccacaggagagacacugggagagaaguggaagagacagcuaaacucuuuagacagaaaggaguuugaagaguacaaaagaaguggaauacuagaaguggauaggacugaagccaagucugccuuaagagauggauccaaaaccaagcaugcgguguccagagggucaaguaaaaucagauggauuguugaaagaggaaugauaaaaccaaaaggaaaggucguagaucuugguugcgggaggggaggaugguccuauuauauggcgacacucaagaacgugacugaagugaaaggauauacuaaaggagguccaggacaugaagaaccaauccccauggcuacuuauggcuggaacuuggucaaacuccauucagggguugauguguucuacaaacccacugagcagguggacacccugcucugugacauuggggagucauccucuaauccgacaauagaggaagggaaaacauugagagucuugaagaugguggagccauggcucucuucaaaaccugaguuuugcaucaaaguccucaaccccuacaugccgacaguaauagaagagcuggagaaacugcagagaagacaugguggaagccucgucagaugcccgcuauccaggaauucuacccaugagauguauugggugucaggugcgucgggaaacaucgugaguucuguaaacacaauaucaaagauguuguugaacagguucacaacaagguauagaaaacccacuuaugagaaggacguagaucuuggggcgggaacgagaagugucuccacugaaacagaaaaaccagacaugacaaucauugggagaaggcuucagagauugcgagaagagcauaaagaaaccuggcacuaugaccaggaaaacccauacagaaccugggcguaucauggaagcuaugaagcuccuucgacagguucagcauccuccauggugaacgggguaguaaaacugcugacaaaaccuugggaugugguuccaauggugacccaguuggccaugacagacacaaccccuuuugggcaacaaagaguguucaaggagaagguggauaccagaacaccacaaccaaaacccggcacacgaaagauuaugaccacgacagccaauugguugugggcccuccucgggaagaagaaaagucccagacuaugcacaagggaagaguucaucucaaaaguuaggucaaaugcagccauaggcgcagucuuucaggaagaacagggauggacaucagccagugaagcugugaaugacagccgguucugggaacugguugacaaagaaagggcucugcaucaggaaggaagaugugaaucgugugucuacaacaugaugggaaaacgugagaaaaaauuaggagaguuugguagggccaagggaagccgagcaaucugguacauguggcugggggcgcgguuccuggaauuugaagcccuggguuuuuugaaugaagaccauugguuuagcagagaaaacucauggaguggaguggaaggggaaggucugcacagauugggauacaucuuggaggacauagacaagaaggauggagaccugauauaugcugacgacacagcaggcugggacacgagaaucacugaagaugaucuuuuaaaugaagaacugaucacagaacagauggccccucaccacaagacucuagccaaagccauuuucaaacuaaccuaucaaaacaaaguggugaaaguucucagacccacaccgaaaggagcgguaauggacaucauauccagaaaagaccaaagagguaguggacagguuggaacauaugguuuaaacacauucacuaacauggaaguccaacucauccgccaaauggaagcugaaggagucaucacacaagacgacaugcagaacccagaaggguugaaagaaagaguugagaaauggcugaaagaguguggcgucgacagguugaagaggauggcaaucaguggagaugauugcguggugaagccccuagaugagagguuuagcaccucccuccucuucuugaaugacaugggaaaggugaggaaagacaucccgcagugggaaccauccaagggauggaaaaacuggcaagagguuccuuuuugcucccaccauuuccacaagaucuucaugaaagauggccgcucacugguuguuccaugcagaaaccaggaugaacugauaggaagagccagaaucucgcagggggcuggauggagcuugagagaaacagccugucugggcaaagcuuacgcccagauguggucgcuuauguauuuccauagaagggaccugcgccuagccuccauggccauaugcucagcaguuccaacagaaugguuuccaacaagcagaacaacauggucaauccacgcccaucaccaguggaugaccacugaagauaugcuuaaaguguggaacagaguguggauagaagauaaccccaauaugacugacaagacuccaguccauucgugggaagacauaccuuaccuagggaaaagagaggauuugugguguggaucccugauuggacuuucuuccagagccaccugggcgaagaacauucacacggccauaacccaggucagaaauuugaucggaaaagaggaauacguggauuacaugccagccaugaaaagauacagugcuccuuuugagagugaaggaguuuuguaa

SEQ ID NO: 7898 - RNA, 9867 nt, Artificial Sequence
  derived and/or modified CDS sequence (wt) from DENV-4__KP140942__SS-prME
ucaacgauaacauuguugugcuugauucccaccgugauggcguuucacuugucaacaagagauggcgaaccccucaugauaguggcaaaacaugaaagggggagaccucucuuguuuaagacaacagaggggaucaacaaaugcacucucauugcuauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuugacaccacauucaggaaugggauuggaaacaagagcugagacauggaugucaucggaaggggcuuggaagcaugcucagagaguagagagcuggauacucagaaacccaggauuugcgcucuuggcaggauuuauggcuuauaugauugggcaaacaggaauccagcgaacugucuucuuuguccuuaugaugcuggucgccccauccuacggaaugcgaugcguaggaguaggaaacagagacuuuguggaaggagucucagguggagcaugggucgaccuggugcuagaacauggaggaugcgucacaaccauggcccagggaagaccaaccuuggauuuugaacugacuaagacaacagcuaaggaaguggcucuguuaagaaccuauuguauugaagccucaauaucaaacauaacuacggcaacaagauguccaacgcaaggagagccuuaucugaaagaggaacaggaucaacaguacaucugccggagagaugugguagacagaggaugggguaauggcuguggcuuguuuggaaaaggaggaguugugacaugugcgaaguuuucauguucggggaagauaacaggcaaucugguccaaauugagaaccuugaauacacagugguuguaacaguccacaauggagacacccaugcaguagggaaugacacaucuaaucauggaguuacagccacgauaacucccaggucaccaucgguagaagucgaacugccggacuauggagaacuaacacucgauugugaaccuaggucuggaauugacuuuaaugagaugauccuaaugaaaaugaacaagaaaacauggcuugugcauaagcaaugguuuuuggaucuaccucuuccauggacagcaggagcagacacaucagagguucacuggaauaacaaagagagaauggugacauuuaagguuccucaugcuaagagacaggaugugacagugcugggaucucaggaaggagcuaugcauucagcccucgcuggagccacagaaguggacuccggugauggaaaucacauguuugcaggacaucucaagugcaaaguccguauggagaaauugagaaucaaaggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugauugggcgcguuaucucaucuaucccuuuggcugagaauaccaacagugugaccaacauagaauuagaaccccccuuuggggacagcuacauagugauagguguuggaaacagcgcauuaacacuccauugguuuaggaaagggaguuccauuggcaagauguucgaguccacauacagaggugcaaaacgaauggccauucuaggugagacggcuugggauuuugguucuguugguggacuguucacaucauugggaaaggcugugcaccagguuuuuggaaguguguacacaaccauguuuggaggagucucauggaugauuagaaucuuaauuggguucuuaguguuguggauuggcacgaacucaaggaacacuucaauggccaugacgugcauagcugucggaggaaucacucuguucuugggcuucacaguucaagcggacauggguuguguggugucauggagugggagagaguugaaauguggaagcggaauuuuugugauugacaacgugcacacuuggacagaacaguacaaauuccaaccagaguccccagcgagacuagcgucugcaauauuaaaugcccacaaagauggggucuguggaauuagaucaaccacgaggcuggaaaaugucauguggaagcaaauaaccaaugagcuaaacuauguucucugggaaggaggacaugaucuuacuguaguggcuggggaugugaaggggguguugaccaaaggcaagagagcacucacacccccagcaagugaucugaaauauucauggaagacauggggaaaagcaaaaaucuucaccccugaagcaagaaacagcacauuuuuaauagacggacccgauaccucugaaugccccaaugaacgaagagcauggaauucucuugagguggaagacuauggauuuggcauguucacgaccaacauauggaugaaauuccgagaaggaaguucagaaaugugugaccauagguuaaugucagcugcaauuaaagaucagaaagcugugcaugcugauauggguuauuggauagagagcucaaaaaaccagaccuggcagauagagaaagcaucucuuauugaagugaaaacaugucuauggcccaagacucacacacuguggagcaauggagugcuggaaagccagaugcucauuccaaaaucauaugcgggcccuuuuucacagcacaacuaccgucagggcuaugccacgcaaaucgcaggcccauggcacuuaggcaaacuagagauagacuuuggagaaugccccggaacaacagucacaauucaggaggauugugaccacagaggcccaucuuugaggaccaccacugcaucuggaaaguuagucacgcaaugguguugccgcuccugcacgaugccccccuuaagguucuugggagaagaugggugcugguaugggauggagauuaggcccuugagugaaaaagaagagaauauggucaaaucacagguggcggccggacagggcacaucagagacuuuuucuaugggucuguugugccugaccuuguuuguggaagaaugcuugaggagaagagucacuaggaagcacaugauacuagcuguggugaucacucuuugugcuaucauccugggaggccucacauggauggacuugcuacgagcccucaucauguugggggacacuaugucugguagaaugggaggacagacccaccuagccaucauggcuguauucaagaugucaccaggauaugugcuggguguauuuuuaaggaaacucacuucaagagagacagcacuaaugguaauaggaauggccaugacaacgacacuuucaauuccacaugaccuuauggaacucauugauggaauaucacuaggacuaauuuugcuaaaaauaguaacacaguuugacaacacccaagugggaaccuuagcucuuucuuugacuuucauaagaucaacaaugucacuggucauggcuuggaggaccauuauggcuguguuguucguagucacacucauuccuuugugcaggacaagcugucuucaaaaacagucucacuggguagaaauaacagcacucauccuaggagcccaagcucugccaguguaccuaaugacucuuaugaaaggggccucaaaaagaucuuggccucucaacgagggcauaauggcugugggucugguuagucucuuaggaagcgcucuuuugaagaaugaugucccuuuagcaggcccaaugguagcaggaggcuuacuucuggcggcuuacgugaugaguggcagcucagcagaucugucacuagagaaggccgcuaaugugcagugggaugaaauggcagacauaacaggcucaaguccaaucauagaagugaagcaagaugaggauggcucuuucuccauacgagacgucgaggaaaccaauaugauaacccuuuuggugaagcuggcauugauaacagugucaggucucuaccccuuggcaauuccagucacaaugacccuaugguauauguggcaagugaaaacacaaagaucaggagcccugugggacguccccucacccgcugccacucaaaaagccgcacugucugaaggaguguacaggaucaugcaaagaggguuauucgggaaaacucagguuggaguagggauacauauggaagguguguuccacacaauguggcauguuacaagaggaucagugaucugccaugagacugggagauuggagccaucuugggcugacgucaggaaugacaugauaucauacggugggggauggaggcuuggagacaaaugggacaaagaagaagacguucagguucucgcuauagaaccagggaaaaaucccaaacauguccaaacgaaaccaggccuuuucaagacccuaacuggagaaauuggagcaguaacauuagauuucaaacccggaacgucugguucucccaucaucaacaggaaaggaaaagucaucggacucuauggaaauggaguggucaccaaaucaggugauuacguuagugcuauaacgcaagccgaaagaauuggagagccagauuaugaaguggaugaggacauuuuucggaagaaaagauuaacuauaauggacuuacaccccggagcuggaaagacgaaaagaauucuuccaucaauagugagagaagcccuaaaaagaaggcugcgaacuuugauucuggcucccacgagagugguggcggccgaaauggaagaggcccuacguggacugccaauccguuaccagaccccagcugugaaaucagaacacacaggaagagagauuguagaccucaugugucaugcaaccuucacaacaagacuuuugucaucaacuaggguuccaaauuacaaccucauaguaauggacgaggcacauuucaccgauccuuccagugucgcggcuagaggauacauuucgaccaggguggaaaugggagaagcggcagccaucuucaugaccgcaaccccccccggagcgacagaucccuuuccccagagcaacagcccaauagaagacaucgagagagagauuccggaaaggucauggaacacaggguuugauuggauaacagacuaucaagggaaaacugugugguuuguucccagcauaaaagcuggaaaugauauugcaaauuguuugagaaagucgggaaagaaagucauucaguugaguaggaaaaccuuugacacagaauauccgaaaacgaaacucacggacugggacuuuguggucacuacagacauaucugaaaugggggcuaacuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccauuaaaaaaugaugaagaucaugcccacuggacagaagcaaagaugcugcuugacaauaucuacaccccagaagggaucauuccaacacuguuugguccggaaagggaaaaaacccaagccauugauggagaguuucgucucagaggggaacaaaggaagacuuuuguggaauugaugaggagaggagaccuuccaguguggcugagcuauaagguagcaucugcuggcauuucuuacaaagaucgggaauggugcuucacuggggaaagaaacaaucaaauuuuagaagaaaacauggagguugaaauuuggacuagagagggggaaaagaaaaaacugaggccaagaugguuagaugcacguguauaugcugaccccauggcuuugaaggauuucaaggaguuugccaguggaaggaagaguuugacucucgacauucuaacagagauugccaguuugccaacuuaucuuuccucuagggccaagcucgcccuugauaacauagucaugcuccacacaacagaaagaggagggagggccuaucaacaugcccugaacgaacuuccggagucacuggaaacacucaugcuuguagccuuacuaggugcuaugacagcaggcaucuuccuguuuuucaugcaagggaaaggaauagggaaauugucaauggguuugauaaccauugcgguggcuaguggcuugcucuggguagcagaaauccaaccucaguggauagcggccucaaucauacuggaauuuuuucucaugguacuguugauaccagaaccagaaaaacaaaggaccccacaagacaaucaauugaucuacgucauauugaccauucucaccauuauaggucuaauagcagccaacgagauggggcugauagaaaaaacaaaaacggauuuuggguuuuaccagguaaagacagaaaccaccauccucgauguggauuugagaccagcuucggcauggacgcucuaugcaguagccaccacaauucugacucccaugcugagacacaccauagaaaacacaucggccaaccuaucuuuagcagccauugccaaccaggcagccguccuaauggggcuuggaaaaggauggccgcuccacagaauggaccucggugugccgcugcuggcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacaguaauagaucuagagccaauauccuaugacccaaaauuugaaaagcaauuagggcaggucaugcuacuaguccugugugcuggacaacuacuccugaugagaacaacaugggcuuucugugaagucuugacuuuggccacaggaccaaucuugaccuugugggagggcaacccgggaagguuuuggaacacgaccauagccguauccacagccaacauuuucaggggaaguuacuuagcgggagcuggacuggcuuuuucacucauaaagaaugcacaaaccccuaggaggggaacugggaccacaggagagacacugggagagaaguggaagagacagcuaaacucauuagacagaaaagaguuugaagaauauaaaagaaguggaauacuggaaguggacaggacugaagcuaagucugcccugaaagaugggucuaaaaucaagcaugcagugucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauaccuauggcuacuuauggcuggaauuuggucaaacuccauucagggguugacguguucuauaaacccacagagcaaguggacacccugcucugugauauuggggagucaucuucuaauccaacaauagaggaaggaagaacauuaagaguucugaagaugguggagccauggcucucuucaaaaccugaauucugcauaaaaguccuuaaccccuacaugccaacagucauagaagagcuagagaaacugcagaggaaacauggugggaaccuugucagaugcccgcuguccaggaacuccacccaugagauguauugggugucaggagcgucgggaaacauugugagcucugugaacacaacaucaaagauguuguugaacagauucacaacaaggcauaggaaacccacuuaugagaaggacguagaucuuggggcaggaacgagaagugucucuacugaaacagaaaaaccagacaugacaaucauugggagaaggcuucagcgauugcaagaagagcacaaagaaacauggcauuaugaucaggaaaacccauacagaaccugggcguaccauggaagcuaugaagcuccuucgacaggcucugcauccucuauggugaacgggguggugaaacugcuaacaaaacccugggaugugauuccaauggugacucaguuagccaugacagauacaaccccuuuugggcaacaaagaguguucaaagagaagguggauaccagaacaccgcaaccaaaaccaggcacacgaauggucaugaccacgacagccaauuggcuaugggcccuccuuggaaagaagaagaaucccagacugugcacaaaggaagaguucaucucaaaaguuagagcaaacgcagccauaggcgcagucuuucaggaagaacagggauggacaucagccagugaagcugugaaugacagccgguuuugggagcugguugacaaagaaagggcccuucaccaggaagggaaaugugaaucgugugucuacaacaugaugggaaaacgugagaaaaaguuaggagaguuuggcagagccaagggaagccgagcaaucugguacauguggcugggagcucguuuucuggaauuugaagcccuggguuuuuugaaugaagaccacugguuuggcagagaaaauucauggaguggaguggaaggggaaggucugcacagauugggauacauccuggaggagauagacaagaaggauggagaccuaauguaugcugacgauacagcaggcugggacacaagaaucacugaggaugaccuucaaaaugaggaacugaucacggaacagauggcuccccaccauaagauccuagccaaagcuauuuucaaacuaaccuaucaaaacaaaguggugaaaguccucagacccacaccgagaggagcggugauggacaucauauccaggaaagaccaaagagguaguggacaaguuggaacauaugguuugaacacauucaccaacauggaaguccaacucauccgccaaauggaagcugaaggagucaucacacaagaugacaugcagaacccaaaaggguugaaagaaaggguugagaaauggcugagagaguguggugucgacagguuaaaaaggauggcaaucaguggagacgauugcguggugaagccccuagaugagagauuugccacuucccuccucuucuugaacgacaugggaaaggugaggaaagacauaccgcagugggaaccaucuaagggauggaaaaacuggcaagagguuccuuuuugcucccaccacuuucacaagaucuuuaugaaggauggccgcucacuaguaguuccauguagaaaccaggaugaacugauagggagagcuagaaucucgcagggggcuggauggagcuugaaagaaacagccugccuggccaaagcuuacgcccagauguggucgcuuauguacuuccacagaagggaucugcguuuggccuccauggccauaugcucagcaguuccaacggaaugguuuccaacaagcagaacaacauggucaauccacgcucaucaccaauggaugaccacugaagacaugcucaaaguguggaacagaguguggauagaggacaaccccaauaugauugacaagacuccaguccauucgugggaagacauaccuuaccuagggaaaagagaggauuuaugguguggauccuugauuggacuuucuucuagagccaccugggcgaagaacauucacacggccauaacucaggucaggaaccugaucggaaaagaggaauacauggauuacaugccaguaaugagaagauacagugcuccuucagagagugaaggaguucuguaa

SEQ ID NO: 7899 - RNA, 9867 nt, Artificial Sequence
  derived and/or modified CDS sequence (wt) from DENV-4__KU523871__SS-prME
ucgacaaugacauugcuguguuugauucccaccgugauggcguuucaccugucaacaagagauggcgaaccccucaugauaguggcaaaacacgaaagggggagaccucucuuguuuaagacaacagaagggaucaacaaauguacccuuauugcuauggaccugggugaaaugugcgaagacacugucacguauaaguguccucuacugguuaacaccgaaccugaagacauugacugcuggugcaaucucacguccaccugggucauguacgggacaugcacccagaacggagaacggagacgagagaagcgcucaguagcuuuaacaccacauucaggaaugggauuggaaacaagagcugagacauggaugucaucggaaggggcuuggaaacaugcucagagaguagaaagcuggauacucagaaacccaggauucgcgcucuuggcaggauuuauggcuuauaugauugggcaaacaggaauccagcgaauuguuuucuuuguccugaugaugcuagucgccccauccuacggaaugcgaugcguagggguagggaacagagacuucguggaaggagucucggguggagcaugggucgacuuggugcuagaacauggaggaugcgucacaaccauggcccagggaaagccaaccuuagauuuugaauugacuaagacaacagccaaggaaguagcucuguuaagaaccuauugcauugaagccucgauaucaaacauaaccacggcaacaagauguccaacgcaaggagagccuuaucucaaagaggagcaagaccaacaguacauuugccggagagacgugguagacagaggauggggcaauggcuguggcuuauuuggaaagggaggaguugugacaugugcaaaguuuucauguucggggaagauaacaggcaaucugguccaaauugaaaaccuugaauacacaguaguaguaacaguccacaauggagacacccaugcaguaggaaaugacacauccaaccauggagugacagccacaauaacuccuaggucaccaucgguagaaguuaaauugccggacuauggagaacuaacacucgauugcgagcccagguccggaauugauuuuaaugagaugauccugaugaagaugaaaaagaaaacguggcuugugcauaagcaaugguuuuuagaccuaccucuaccauggacggcaggagcagauacaucagaaguucauuggaaucauaaagagagaauggugacauucaagguuccucaugccaagagacaggaugugacagugcuaggaucucaggagggggcuaugcauucugcccucgccggagccacagaaguggauucuggugauggaaaucacauguuugcaggacaucucaagugcaaaguccgcauggagaaauugagaauuaaaggaaugucauacacgauguguucaggaaaguucucaauugacaaagagauggcagaaacacagcauggaacuacaguggugaaagucaaguaugaaggcgcuggagcuccguguaaaguucccauagagauaagagaugugaacaaggaaaaaguggucggacguaucaucucaucuaccccuuuugcugagaauaccaacagcguaaccaacauagaauuagaacccccuuuuggggacagcuacauagugauagguguuggagagagugcauuaacacuccauugguucagaaaagggagcuccauuggcaagauguuugaguccacauacagaggugcaaaacgaauggccauucuaggugaaacagcuugggauuuuggcucuguugguggacuguucacaucauugggaaaggccguacaccagguuuuuggaaguguguauacaacuauguuuggaggggucucauggaugguuagaauccuaauuggauucuuaguauuguggauuggcacaaauucaagaaacacuucaauggcaaugacgugcauagcuguuggaggaaucacucuguuucuggguuuuacaguucaagcagacauggguuguguggugucauggagugggaaggaauuaaaauguggaagcggaauuuuugugguugacaacgugcacacuuggacagaacaguacaaauuucaaccagaguccccagcaagacuagcgucugcaauauugaaugcccacaaagauggggucuguggaauuagaucaaccacgaggcuggaaaauguuauguggaagcaaauaaccaaugagcuaaacuauguucucugggaaggaggacaugaccucacuguaguggcuggggaugugaaggggguguugaccagaggcaagagagcacucacaccuccagugaaugaucugaaauauucauggaagacauggggaaaagcaaaaaucuuuaccccagaagcaagaaacaguacguuuuuaauagacggaccagacaccuccgaaugccccaaugagcgaagagcauggaacuuuuuugagguagaagacuauggauuuggcauguuuacgaccaacauauggaugaaauuccgagaaggaaguucagaagugugugaccauagacuaaugucggcggcaaucaaagaucagaaagcugugcaugcugacauggguuauuggauagagagcucaaaaaaccagaccuggcagauagagaaagcaucccuuauugaagugaaaacaugucuguggcccaaaacccacacgcuguggagcaauggagugcuggaaagucagaugcucauuccaagaucauaugcaggccccuuuucacagcacaauuaccgucagggcuaugccacgcaaaccgugggcccauggcaccuaggcaaauuggagauagacuuuggagaaugccccgggacaacagucgcaauucgggaggauugugaccacagaggcccaucuuugagaaccaccacugcaucuggaaaacuggucacgcaauggugcugccgcuccugcacgaugccucccuuaagguucuugggagaagauggauguugguaugggauggagaucaggccucugagugaaaaagaagagaacauggucaaaucacaggcaacggccggacagggcacaucagaaacuuuuucuauggggcuguuaugccugaccuuguuuguggaagaaugcuugaggagaagaguuacuaggaaacacaugauauugguugugguaaucaccuuuugcgcuaucauccuaggaggucucacauggauggacuuacuacgagcccuuaucauguuaggggauacuaugucugguagaauaggaggacagauccaccuagccaucauggcaguguuuaagaugucaccaggauacgugcuggguguguuuuuaaggaaacuuacuucaagagagacagcgcugaugguaauaggaauggccaugacaacgguguuuucaaucccacaugaccuuauggaacucauugauggaauaucauugggguugauauuacuaaaaauaguaacacauuuugacaacacccaagugggaacccuagcccuuuccuugacuuuuuuaagaucaacaacaccauuagucauggcuuggaggaccauuauggcuguguucuuuguggucacacucauuccuuuguguaggacaagcugucuucaaaaacagucccacuggguagaaauaacagcacucauccuaggagcccaggcuuugccaguauaccuaaugacucucaugaagggagccucaaggagaucuuggccucucaaugagggcauaauggcuguagguuuggugagccucuuaggaagcgcccucuugaagaaugauguuccuuuggcuggcccaaugguggcaggaggcuugcuucuagcggcuuacguaaugagugguagcucagcagaccugucacuagagaaagcugccaacgugcagugggaugaaauggcggacauaacuggcucaagcccaaucauagaagugaagcaggaugaagauggcucuuuuuccauacgggacgucgaggaaaccaauaugaugacucucuuggugaaacuggcacugauaacaguaucaggucuuuaccccuuggcaauuccagucacaauggcauuaugguauauuuggcaagugaagacacaaagaucaggagcucugugggacguccccucacccgcugccacccagaaagccacacugucugaaggaguguauaggauuaugcaaagagggcuguuugggaaaacucaaguuggaguaggaauacacauggaaggcguauuucacacaauguggcauguaacaaggggaucagugaucugucaugagacagggagauuagagccaucuugggcugacgucagaaacgacaugauaucauacggugggggauggaggcucggagacaaaugggacaaagaagaagauguucaggucuuagccauagaaccagggaaaaaucccaaacauguccaaacgaaaccuggccuuuucaagacccuaacuggagaaauuggagcaguaacucuggauuucaaacccggaacgucuggcucucccaucauuaacaagaaagggaaaguuauuggacucuauggaaauggagugguuaccaaaucaggugauuaugucagugccauaacgcaagccgagagaauuggugagccagauuaugaaguugaugaggacauuuuucgaaagaaaagauuaaccauaauggauuuacaccccggagcuggaaagacaaaaagaauccucccaucaauagucagagaggcuuuaaaaaggaggcugcgaacccugauuuuggcucccacgagagugguggcggccgagauggaagaggcccuacguggguugccaauccguuaucagacuccagcugugaaaucagagcacacaggaagagagauuguagaccucaugugucaugcaaccuuuacaacaagacuuuugucaucaaccaggguuccuaauuauaaccucauagugauggaugaagcacauuucacugacccuugcagugucgcggcuagaggauacauuucaaccaggguggaaaugggagaggcagcagcuaucuucaugacugcaaccccuccuggagcgacagauccuuucccccagagcaacagcccaauagaagacaucgagagggaaauuccagaaaggucauggaacacaggguucgacuggauaacagacuaccaagggaaaacugugugguuuguucccagcauaaaagcuggaaaugacauugcaaauuguuugagaaagucgggaaagagagugauccaguugagcaggaaaaccuuugacacggaguauccaaagacgaaacucacggacugggauuuuguggucaccacagauauaucugaaaugggggccaauuucagagcugggagagugauagaccccaggagaugccucaagccaguuauccuaacagaugggccagagagaguuauucuagcagguccaaucccaguaacuccagcaagugccgcucagagaagagggcgaauagguaggaauccagcacaggaagaugaccaauauguuuucuccggagacccacuaaaaaaugaugaagaucaugcucacuggacagaagcaaagaugcugcuugacaauaucuacaccccugaagggauaauuccaacacuguuugguccggaaagggaaaaaacccaagccaucgauggagaguuucgccucagaggggaacaaaggaagacuuuuguggaauuaaugaagagaggagaccuuccgguguggcugagcuacaagguagcuucugccgguaucuccuacaaagaucgagaauggugcuucacaggagaaaggaauaaccaaauuuuagaagaaaacauggagguugaaauuuggacuaaagagggagaaaagaaaaagcuaaggccaaaaugguuggaugcacguguguacgcugaucccauggcuuugaaggauuucaaggaguucgccaguggaagaaagagcauaacucucgacaucuuaacagagauugccaguuugccaacuuaccuuuccucuaaggccaagcuggcucuugacaacauaaucaugcuccacacaacagaaaaaggagggagggccuaccaacacgcccugaacgaacucccggagucacuggaaacgcucaugcuuguagcucuacuaggugcuaugacagcaggcaucuuccuguuuuucaugcaggggaaaggaauaggaaaauugucaaugggucuaauagccauagcuguggcuaguggcuugcucuggguagcagaaauucagccccaguggauagcagcuucaaucauacuggaguucuuucuuauggugcuguugauaccagaaccagaaaaacaaaggaccccacaagacaaucaauugaucuacgucauauugaccauucucaccaucaucggucuuauagcagccaaugagauggggcugauugaaaaaacaaaaacugacuuuggguuuuaccagguaaaaacagaaacaacuauucuugauguggauuugagaccagccucagcauggacacucuaugcgguagccaccaccauucugacucccaugcugagacacaccauagaaaacacgucugccaaccuaucucuagcagccauugccaaccaagcagcuguucuaaugggacuuggaaaaggauggccgcuccacagaauggaccucggugugccgcuguuagcaauaggauguuauucucaagugaacccaacaacccugacagcauccuuagucaugcuuuuaguccauuaugccauaauagguccaggauugcaggcaaaagccacacgagaggcccagaaaaggacagcugcugggaucaugaagaaccccacgguggacgggauaacaguaauagaucuagaaccaauauccuaugacccaaaauuugaaaagcaauuagggcaagucauguuacuaguccugugugcuggacaauuacuuuugaugagaacaacaugggcucucugcgaagucuugacuuuggccacaggaccagccaugaccuugugggagggcaacccgggaagguuuuggaacacgaccauagcuguauccacagccaacauuuucagaggaagcuaucuggcaggagcuggacuagcuuuuucgcucauaaagaaugcacaaaccccuaggaggggaacugggaccacaggagagacacugggagagaaguggaagagacaguuaaacucauuagacagaaaagaguuugaagaguacaaaagaaguggaauacuagaaguggauaggacugaagccaagucugcccuaaaagauggaucuaaaaucaagcaugcgguguccagagggucuaguaagaucagauggauuguugaaagagggaugguaaagccgaaagggaaggucguggaucuugguugcgggaggggaggaugguccuauuacauggcgacacuuaagaacgugacugaagugaaaggauauacaaaaggagguccaggacaugaggaaccaauccccauggcuacuuauggcuggaacuuggucaaacuccauucagggguugauguguuuuacaaacccacugagcagguggacaccuugcucugugacauuggggagucguccucuaauccgacaauagaggaaggaaggacauugagagucuugaagaugguagagccauggcucucuucaaaaccugaguucugcaucaaaguccucaaccccuacaugccgacaguuauagaagagcuggagaaacugcagagaagacaugguggaagccucgucagaugcccgcuauccaggaauucuacccaugagauguauugggugucaggugcgucgggaaacaucgugaguucugugaacacaauaucaaagaugcuguugaacagguucacaacaaggcauagaaaacccacuuaugagaaggacguagaucuuggggcaggaacgagaagugucuccacugaaacagaaaaaccagacaugacaaucauugggagaaggcuucagagauugcgagaagagcacaaagaaaccuggcacuaugaccaggaaaacccauauagaaccugggcguaucauggaagcuaugaagcuccuucgacagguucagcauccuccauggugaacgggguaguaaaacugcugacaaaaccuugggaugugguuccaauggugacucaguuggccaugacagacacaaccccuuuugggcaacaaagaguguuuaaggagaagguggauaccagaacaccacaaccaaaacccggcacacgaaugauuaugaccacgacagccaauugguuguggacccuccucgggaagaagaaaagucccagacugugcacaagggaagaguucaucucaaaaguuaggucaaaugcagccauaggcgcagucuuucaggaagaacagggauggacaucagccagugaagcugugaaugacagccgguucugggaacugguugacaaagaaagggcucugcaccaggaaggaaaaugugaaucguguguuuacaacaugaugggaaaacgugagaaaaaauuaggagaguuugguagggccaagggaagccgagcgaugugguacauguggcugggggcgcgguuccuggaauuugaagcccuggguuuuuugaaugaagaucauugguuuagcagagaaaacucauggaguggaguggaaggggaaggucugcacagauugggauacaucuuggaggacauagacaagaaggauggagaccugauauaugcugacgacacagcaggcugggacacgagaaucacugaggaugaccucuuaaaugaagaacugaucacagaacagauggccccccaucacaagacccuagccaaagccauuuucaaacuaaccuaucaaaacaaaguggugaaaguccucagacccacaccgaaaggagcggugauggacaucauauccaggaaagaccaaagagguaguggacagguuggaacauaugguuuaaacacauucacuaacauggaaguucaacucauccgccaaauggaagcugaaggagucaucacacaagacgacaugcagaacccaaaaggguugaaagaaagaguugagaaauggcugacagaguguggcgucgacagguugaagaggauggcaaucaguggagaugauugcguggugaagccccuagaugagagguucagcaccucccuccucuucuugaacgauaugggaaaggugaggaaagacaucccgcagugggaaccauccaaaggauggaaaaacuggcaagagguuccuuuuugcucccaccauuuucauaagaucuuuaugaaagauggccgcucacuaguuguuccaugcagaaaccaggaugaacugauaggaagagccagaaucucgcaaggggcuggauggagcuugagagaaacagccuguuugggcaaagcuuacgcccaaauguggucgcuuauguauuuccauagaagggaccuacguuuagccuccauggccauauguucagcaguuccaacggaaugguuuccaacaagcaggacaacauggucaauccacgcucaucaccaguggaugaccacugaagacaugcucaaaguguggaacaggguguggauagaagacaaccccaauaugacugacaagacuccagucuauucgugggaagacauaccuuaccuagggaaaagagaggauuugugguguggaucccugauuggacucucuuccagagccaccugggcgaagaacauucacacggccauaacccaggucaggaaucugaucggaaaagaggacuacguggauuacaugccaaucaugaaaagauauagcgcuccuuccgaaagugaaggaguucuguaa

SEQ ID NO: 7900 - RNA, 9867 nt, Artificial Sequence
  derived and/or modified CDS sequence (wt) from DENV-4__HQ332175__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaagccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugucggagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucauggaguuacagccacgauaacucccaggucaccaucgguagaagucaaacugccggacuauggagaacuaacacucgacugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguagugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaaguggaaucuuugugguugacaacgugcacacuuggacagaacaguacaaauuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaaaacaugggggaaagcaaaaaucuucaccccugaagcaagaaacagcacauuuuuaauagacggaccagauaccucugaaugccccaaugaacgaagagcauggaauucuuuugagguggaagacuauggauuugguauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaauguuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguuuaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucaguagaucugucacuagagaaggccgcuaaugugcaaugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacuguccgaaggaguguacaggaucaugcaaagaggguuauucgggaaaacucagguuggaguagggauacacauggaagguguauuucauacaauguggcaugucacaagaggaucggugauuugccacgagacugggagauuggagccaucuugggcugacgucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuaucccagugacuccagcaagcgcugcccagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaucuuccgguguggcugaguuauaagguagcuucugcuggcauuucuuacaaagaucgggaaugguguuucacuggggaaagaaauaaccaaauuuuagaagaaaacauggagguugaaauuuggacuagagagggagaaaagaaaaaacugagaccaaaaugguuagaugcacguguauacgcugaccccauggcuuugaaggauuucaaggaguuugccaguggaaggaagaguauaacucucgacauccuaacagagaucgccaguuugccaaccuaccuuuccucuagggccaagcucgcccuugacaacauaguuaugcuucacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaacacgucggccaaccuaucuuuagcagcuaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauuccaauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcacaggaaacccacuuaugagaaggacguagaucuuggggcaggaacgagaagugucuccacugaaacagaaaaaccagacaugacaaucauugggagaagacuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaaugaagaccauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccaucuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccaccgaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauagcucaggucaggaaucugaucggaaaagaggaauacguggauuacaugccaguaaugaaaagauacagugcuccuucagagagugaaggaguucuguaa

SEQ ID NO: 7901 - RNA, 9867 nt, Artificial Sequence
  derived and/or modified CDS sequence (wt) from DENV-4__HQ332172__SS-prME
ucaacgauaacauuguugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucugccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaauuccaaccagaguccccagcgagacuagcgucugcaauauuaaaugcccacaaagacggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaacuguggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugaggagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccucuuaacgaaggcauaauggcuguggguuugguuagucuccuaggaagcgcucuuuuaaaaaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccacugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugacgucaggaaugauaugauaucauacggugggggauggaggcuuggagauaaaugggacaaagaagaagacguucagguccucgcuauagaaccaggaaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaaggauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauagucaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagcuaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccauccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgccuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuuuaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaaaaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaacccuuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagacacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcacuucccuccucuucuugaacgacaugggaaaggugaggaaagauauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcgucuagccuccauggccauaugcucagcaguuccaacggaaugguuuccaacaagcagaacaacauggucaauccaugcucaccaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7902 - RNA, 9867 nt, Artificial Sequence
  derived and/or modified CDS sequence (wt) from DENV-4__HQ332176__SS-prME
ucaacgauaacauuguugugcuugauucccaccguaauggcguuucacuugucaacaagagauggcgaaccccucaugauaguggcaagacaugaaagggggagaccucucuuguuuaagacaacagaggggaucaacaaaugcacucucauugccauggacuugggugaaaugugugaggacacugucacguauaaauguccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacaagauguccaacgcaaggagagccuuaucugaaagaggaacaggaccaacaguacauuugccguagagaugugguagauagaggauggggcaauggcuguggcuuguuuggaaaaggaggaguugugacaugugcgaaguucucauguucggggaagauaacaggcaaucugguccaaauugagaaccuugaauacacagugguugugacaguccacaauggagacacccaugcaguaggaaaugacacauccaaucauggaguuacagccacgauaacucccaggucaccaucgguugaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagauacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcguuaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaaucuuaauuggguucuuaguguuguggauuggcacgaacucaaggaacacuucaauggccaugacgugcauagcuguugguggaaucacucuguuuuugggcuucacgguccaagcggacauggguuguguggugucauggagugggagagaauugaaguguggaagcggaauuuuugugguugacaacgugcauacuuggacagaacaguacaaauuccaaccagaguccccagcgagacuagcgucugcaauauuaaaugcccacaaagauggggucuguggaauuagaucaaccacgagacuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagauaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucucauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccguggguccauggcacuugggcaaacuagagauagacuuuggagaaugccccggaacaacaguuacaauucaggagaauugugaccauagaggcccaucuuugaggaccaccacugcaucuggaaaacuagucacgcaaugguguugccgcuccugcacaaugccccccuuaagguucuuaggagaagaugggugcugguaugggauggagauuaggcccuugagugaaaaagaagagaacaugguuaaaucacaggugacggccggacagggcacaucggaaacuuuuucuaugggucuguugugccugaccuuguuuguggaagaaugcuugagaagaagagucaccaggaaacacaugauauuagcugugguaaucacucuuugugcuaucauccuggggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucaucuuaggagcccaagcucugccaguguaccuaaugacucuuaugaaaggagccucaagaagaucuuggccucuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacuguccgaaggaguguacaggaucaugcaaagaggguuauucgggaaaacccagguuggaguagggauacacauggaagguguauuucacacaauguggcaugucacaagaggaucggugaucugccacgagacugggagauuggagccaucuugggcugacgucaggaaugacaugauaucauacggugggggauggaggcuuggagauaaaugggacaaagaagaggacguucagguccucgcuauagaaccagggaaaaaucccaaacauguccaaacgaaaccuggccuuuucaagacccuaacuggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagaguaguggcggccgagauggaagaggcccuacguggacugccaauccguuaccaaaccccagcugugaaaucagaacacacaggaagagagauuguagaccucaugugccaugcaaccuucacaacaagacuuuugucaucaaccagaguuccaaacuauaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcaggucccauuccagugacuccagcaagcgcugcccagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagcuauugauggagaguuucgccucagaggggaacaaaggaagacuuuuguggaauuaaugaggagaggagaccuuccgguguggcugaguuauaagguagcuucugcuggcauuucuuacaaagaucgggaauggugcuucacuggggaaagaaauaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacacgccuugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccccaguggauagcggccucaaucauacuggaguuuuuucucaugguacuguugauaccagaaccagaaaaacaaaggaccccacaagacaaucaauugaucuacgucauauugaccauucucaccauuauuggucuaauagcagccaacgagauggggcugauagaaaaaacaaaaacggauuuuggguuuuaccagguaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggcuacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaaguccgcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauuccuauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaagguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccucuuaugagaaggacguagaucuuggggcaggaacgagaagugucuccacugaaacagagaaaccagacaugacaaucauugggagaaggcuucagcgauugcaagaagagcacaaagaaacauggcauuaugaucaggaaaacccauacagaaccugggcguaucauggaagcuaugaagcuccuucgacaggcucugcguccuccaugguaaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaaugguuaugaccacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacugguugacaaagaaagggcccuucaccaagaagggaaaugugaaucgugugucuauaacaugaugggaaaacgugagaaaaaguuaggagaguuuggcagagccaagggaagccgagcaaucugguauauguggcuaggagcgcgguuucuggaauuugaagcccuggguuuuuugaaugaagaucauugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgauugcguggugaaaccccuagaugagagguuuggcaccucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcgucuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauacagugcuccuucagagagugaaggaguucuguaa

SEQ ID NO: 7903 - RNA, 9867 nt, Artificial Sequence
  derived and/or modified CDS sequence (wt) from DENV-4__HQ332174__SS-prME
ucaacgauaacauuguugugcuugauucccaccgcaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcguucaguagcuuuaacaccacauucaggaaugggacuggaaacaagagcugagacauggaugucaucggaaggggcuuggaagcaugcucagagaguagagagcuggauacucagaaauccaggauuugcacucuuggcaggauuuauggcuuauaugauugggcaaacagggauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugaccaagacaacagccaaggaaguggcucuguuaagaaccuauugcauugaagccuuaauaucaaacauaacuacggcaacgagauguccaacgcaaggagagccuuaucugaaagaggaacaggaccaacaguacauuugccggagagaugugguagauagaggauggggcaauggcuguggcuuguuuggaaaaggaggaguugugacaugugcgaaguucucauguucggggaagauaacaggcaaucugguccaaauugagaaccuugaauacacagugguuguaacaguccacaauggagacacccaugcaguaggaaaugacacauccaaucauggaguuacagccacgauaacucccaggucaccaucgguagaagucaaacugccggacuauggagaacuaacacucgauugugaacccaggucuggaauugacuucaaugagaugauccuaaugaaaaugaaaaagaaaacauggcucgugcauaagcaaugguuuuuggaucugccucuuccauggacaacaggagcagacacaucagagguucacuggaauuacaaagagagaauggugacauuuaagguuccucaugccaagagacaggaugugacagugcugggaucucaggaaggagcuaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcgcgucaucucagccaccccuuuggcugagaauaccaacaguguaaccaacauagaauuagaaccccccuuuggggacagcuacauagugauagguguuggaaacagcgcacuaacacuccauugguucaggaaagggaguuccauuggcaagauguuugaguccacauacagaggugcaaaacgcauggccauccuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggccaugacgugcauagcuguugguggaaucacucuguuuuugggcuucacgguucaagcggacauggguuguguggugucauggagugggagagaauugaaguguggaagcggaauuuuugugguugacaacgugcacacuuggacagaacaguacaaguuccaaccagaguccccagcgagacuagcgucugcaauauuaaaugcccacaaagauggggucuguggaauuagaucaaccacgaggcuggaaaauguuauguggaagcaaauaaccaaugagcuaaacuauguucucugggaaggaggacaugaucucacuguaguggcuggggaugugaaagggguguugaccaagggcaagagagcacucacacccccagcgagugaucugaaauauucauggaagacaugggggaaagcaaaaaucuucaccccugaagcaagaaacagcacauuuuuaauagacggaccagacaccucugaaugccccaaugaacgaagagcauggaauucuuuugagguggaagacuauggauuuggcauguucacgaccaacauauggaugaaauuccgagaaggaaguucagaagugugugaccacagguuaaugucagcugcaauuaaagaccagaaagcugugcaugcugacauggguuauuggauagagagcucaaaaaaccagaccuggcagauagagagagcaucucuuauugaagugaaaacaugucuguggcccaagacccauacacuguggagcaauggagugcuggaaagccagaugcuuauuccaaaaucauaugcgggcccuuuuucacagcacaauuaccgccagggcuaugcuacgcaaaccauggguccauggcacuuaggcaaacuagagauagacuuuggagaaugccccggaacaacagucacaauucaggagaauugugaccauagaggcccaucuuugaggaccaccacugcaucuggaaaacuagucacgcaaugguguugccgcuccugcacgaugccccccuuaagguucuuaggagaagaugggugcugguaugggauggagauuaggcccuugagugaaaaagaagagaacaugguuaaaucacaggugacggccggacagggcgcaucggaaacuuuuucuaugggucuguugugccugaccuuguuuguggaagaaugcuugaggagaagagucaccaggaaacacaugauauuagcugugguaaucacucuuugugcuaucauccuagggggccucacauggauggacuugcuacgagcccucaucauguugggggacacuaugucugguagaauaggaggacagacccaccuagccaucauggcaguguucaagaugucaccaggauacgugcuggguguguuuuuaaggaaacucacuucaagagagacagcacuaaugguaauaggaauggccaugacaacaacacuuucaauuccacaugaccucauggaacucauugauggaauaucacuaggacuaauuuugcuaaaaauaguaacacaguuugacaacacccaagugggaaccuuagcucuuuccuugacuuucauaagaucaacaaugucauuggucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucuuaugaaaggagccucaagaagaucuuggccccuuaacgaaggcauaauggcuguggguuugguuagucucuuaggaagcgcucuuuuaaagaaugaugucccuuuagcuggcccaaugguggcaggaggcuuacuucuggcggcuuacguaaugaguggcagcucagcagaucugucacuagagaaggccgcuaaugugcagugggaugaaauggcagacauaacaggcucaaguccaaucauagaagugaagcaagaugaggauggcucuuucuccauacgggacgucgaggaaaccaauaugauaacccuuuuggugaaacuggcacugauaacggugucaggucucuaccccuuggcaauuccaaucacaaugaccuuaugguacauguggcaagugaaaacacaaagaucaggagcccugugggacgucccuucacccgcugccacucaaaaagccgcacugucugaaggaguguacaggaucaugcaaagaggguuauucgggaaaacucagguuggaguagggauacacauggaagguguauuucacacaauguggcauguuacaagaggaucggugaucugccacgagacugggagauuggagccaucuugggcugaugucaggaaugacaugauaucauacggugggggauggaggcuuggagauaaaugggacaaagaagaagacguucagguccucgcuauagaaccagggaaaaaucccaaacauguccaaacgaaaccuggccuuuucaagacccuaaccggagaaauuggagcaguaacauuagauuucaaacccggaacgucugguucucccauuaucaacaggaaaggaaaagucaucggacucuauggaaauggagugguuaccaaaucaggugauuacgucagugccauaacgcaagccgaaagaauuggagagccagauuaugaaguggaugaggacauuuuucgaaagaaaagacuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaccaaaccccagcuguaaaaucagaacacacaggaagagagauuguagaccucaugugccaugcaaccuucacaacaagacuuuugucaucaaccagaguuccaaacuacaaccuuauaguaauggaugaagcacauuucaccgauccuuccagugucgcggcuagaggauacauuucgaccaggguggaaaugggagaggcagcagccaucuucaugaccgcaaccccucccggagcgacagaucccuuuccccagagcaacagcccaauagaagacaucgagagagagauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaauauccaaaaacgaaacucacggacugggacuuuguggucacuacagacauaucugaaaugggggcuaacuuuagagcugggagagugauagacccuagaagaugccucaagccaguuauccuaacagaugggccagagagagucaucuuagcaggcccuauuccagugacuccagcaagcgcugcucagagaagagggcgaauaggaaggaacccagcacaagaagacgaccaauacguuuucuccggagacccacuaaaaaaugaugaagaucaugcccacuggacagaagcgaagaugcugcuugacaauaucuacaccccagaagggaucauuccaacauuguuugguccggaaagggaaaaaacccaagcuauugauggagaguuucgccuuagaggggaacaaaggaagacuuuuguggaauuaaugaggagaggagaccuuccgguguggcugaguuauaagguagcuucugcuggcauuucuuacaaagaucgggaauggugcuucacuggggaaagaaacaaccaaauuuuagaagaaaacauggagguugaaauuuggacuagagagggagaaaagaaaaaacugaggccaaaaugguuagaugcacguguauacgcugaccccauggcuuugaaggauuucaaggaguuugccaguggaaggaagaguauaacucucgacauccuaacagagaucgccaguuugccaacuuaccuuuccucuagggccaagcucgcccuugacaacauaguuaugcuccacacaacagaaagaggagggagggccuaucaacacgcccugaacgaacuuccggagucacuggaaacacucaugcuuguagccuuacuaggugcuaugacagcagguaucuuccuguuuuucaugcaagggaaaggaauagggaaauugucaauggguuugauaaccauugcgguggcuaguggcuugcucuggguagcagaaauucaaccucaguggauagcggccucaaucauacuagaguuuuuucucaugguacuguugauaccagaaccagagaaacaaaggaccccacaagacaaucaauugaucuacgucauauugaccauucucaccauuauuggucuaauagcagccaacgagauggggcugauagaaaaaacaaaaacggauuuuggguuuuaccaggcaaaaacagaaaccaccauccucgauguggaccugagaccagcuucagcauggacgcucuaugcgguagccaccacaauucugacucccaugcugagacacaccauagaaaauacgucggccaaccuaucuuuagcagccaucgccaaccaggcagccguccuaauggggcuuggaaaaggauggccacuccacagaauggaccucggugugccgcuguuagcaaugggaugcuauucucaagugaacccaacaaccuugacagcauccuuagucaugcuuuuaguccauuaugcaauaauaggcccaggauugcaggcaaaagccacaagagaggcccagaaaaggacagcugcuggaaucaugaaaaaucccacaguggacgggauaacagugauagaucuagaaccaauauccuaugacccaaaauuugaaaagcaauuagggcaggucauguuacucgucuugugugcuggacaacuacucuugaugagaacaacaugggcuuucugugaagucuugacuuuggccacaggaccaaucuugaccuugugggagggcaacccgggaagguuuuggaacacgaccauagccguaucuaccgccaacauuuucaggggaaguuacuuggcaggagcuggacuggcuuuuucacucauaaagaaugcacaaacccccaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagauggguccaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaauuauugggagaaggcuucagcgauugcaagaagagcacaaagaaacauggcauuaugaucaggaaaacccauacagaaccugggcguaucauggaagcuaugaagcuccuucgacaggcucugcguccuccauggugaacgggguggugaaacugcuaacaaaacccugggauguaauuccaauggugacucaguuagccaugacagauacaaccccuuuugggcaacaaagaguguucaaagagaagguggauaccagaacaccgcaaccaaaaccaggcacacgaacaguuaugacuacgacagccaauuggcuaugggcccuccuuggaaagaagaaaaaucccagacugugcacaagggaagaguucaucucaaaaguuagaucaaacgcagccauaggcgcagucuuucaagaggaacagggauggacaucagccagugaagcugugaaugacagccgguuuugggaacuaguugacaaagaaagggcccuucaccaagaagggaaaugugaaucgugugucuauaacaugaugggaaaacgugagaaaaaguuaggagaguuuggcagagccaagggaagccgagcaaucugguauauguggcugggagcgcgguuucuggaauuugaagcccuggguuuuuugaaugaagaucacugguuuggcagagaaaacucauggaguggaguggaaggggaaggucugcacagauugggauacauccuggaggagauagacaagaaggauggagaccuaauguaugcugaugacacagcaggcugggacacaagaaucacugaggaugaucuucaaaaugaggaacugaucacggaacagauggccccccaccacaagauccuagccaaagccauuuucaaacuaaccuaucaaaacaaaguggugaaaguccucagacccacaccgagaggagcggugauggauaucauauccaggaaagaccagagagguaguggacaaguuggaacauaugguuugaacacauucaccaacauggaaguucaacucauccgccaaauggaagcagaaggagucaucacacaagaugacaugcagaacccaaaaggguugaaagaaagaguugagaaauggcugagagaguguggugucgacagguuaaagaggauggcaauuaguggagacgacugcguggugaaaccccuagaugagagguuuggcacuucccuccucuucuugaacgacaugggaaaagugaggaaagauauuccgcagugggaaccaucuaagggauggaaaaacuggcaagagguuccuuuuugcucccaccacuuucacaagaucuuuaugaaggauggccgcucacuaguaguuccauguagaaaccaggaugaacugauagggagagccagaaucucgcagggggcuggauggagcuuaagggaaacagccugccuaggcaaagcuuacgcccagauguggucgcuuauguacuuccacagaagggaucugcguuuagccuccauggccauaugcucagcaguuccaacggaaugguuuccaacaagcagaacaacauggucaauccaugcucaucaccaauggaugaccacugaagacaugcucaagguguggaacagaguguggauagaagacaaccccaauaugauugacaagacuccaguccauucgugggaagauauaccuuaccuagggaaaagagaggauuugugguguggaucccugauuggacuuucuucuagagccaccugggcgaagaacauucacacggccauaacucaggucaggaaucugaucggaaaagaggaauacguggauuacaugccaguaaugaaaagauauagugcuccuucagagagugaaggaguucuguaa

SEQ ID NO: 7904 - RNA, 9867 nt, Artificial Sequence
  derived and/or modified CDS sequence (wt) from DENV-4__KT026308__SS-prME
ucaacaauaacauugcugugcuugauucccacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugugaggacaccgucacguauaaaugccccuuacuggucaauaccgaacccgaagacauugauugcuggugcaaucucacgucuaccuggguuauguaugggacaugcacccaaaguggagaacgaaggcgagagaagcgcucaguagcucuaacaccacauucaggaaugggauuggaaacaagggcugaaacauggaugucaucggaaggagcuuggaaacacgcccagaggguagagaguuggauacucagaaacccaggauucgcgcucuuggcaggguuuauggccuacaugaucgggcaaacaggaauccagcgaacagucuucuucauucuaaugauguuggucgccccaucuuacggaaugcgaugcguaggaguagggaacagagacuuuguagaaggagucucagguggagcaugggucgaucuggugcuagaacauggaggaugugucacaaccauggcccagggaaagccaaccuuggauuuugaacugauuaagacaacagccaaggaaguggcucuguuaagaaccuauugcauugaagcuuccauaucaaacauaaccacagcaacaagauguccaacgcaaggagagccuuaccucaaagaggaacaagaucaacaguacauuugccggagagacaugguagauagaggguggggcaacgguuguggcuuguuugggaagggaggaguugugacaugugcgaaguuuucaugcuuggggaagauaacgggcaacuuaguucaaauugagaaccuugaauacacagugguuguaacaguccacaauggagacacucacgcuguaggaaaugacacaucuaaccauggagugacagccacaauaacccccaggucaccaucgguugaaguucaauuaccggacuauggagaauugacacucgacugugaaccuagguccggaauugacuuuaaugagaugauucugaugaaaaugaaaacgaaaacguggcucgugcacaagcaaugguuuuuggaucuaccucuaccauggacaacaggagcagacacgcuagaaguucacuggaaucacaaagagagaauggugacauucaagguuccucaugccaagagacaggacgugacagugcuaggaucucaggaaggagccaugcauucagcccucgccggagccacagaaguggacuccggugauggaaaccauauguuugcaggacacuuaaaguguaaaguucguauggaaaaguugaggauuaagggaaugucauacacgaugugcucaggaaaguucucaauugauaaagagauggcagaaacacagcauggaacaacagugguaaaggucaaguaugaggguacuggagcuccauguaaaguucccauagagauaagagaugugaacaaggaaaaagugguugggcgcaucaucucauccaccccuuuugcugagaauaccaacagugugaccaauauagaauuggaaccuccuuuuggggauagcuacauagugauaggugugggagacagugcauuaacacuccauugguucaggaaagggagcuccauuggcaagauguuugaguccacauacagaggugcaaagcgcauggccauucuaggugaaacagcuugggauuuugguuccguugguggacugcucacgucauuaggaaaggcuguacaucaaguuuuuggcaguguguacacaacuauguuuggaggagucucauggauggucagaauccuaaucggacucuuaguguuguggauugguacgaauucaagaaacacuucaauggcuaugucgugcauagcuguuggaggaaucacccuguuucugggcuucacaguccaugcagauauggguuguguggugucauggagugggaaagaguugaaauguggaagcggaaucuuuguaauugacaacgugcacaccuggacagaacaguacaaauuucaaccagagucuccagcgcgacuggcgucggcaauacugaaugcccacaaagaaggggucuguggaauuagaucaaccacgaggcuggaaaaugucauguggaaacaaauaacuaaugaguuaaacuauguucucugggaaggaggacaugaccucacuguaguggccggggaugugaaaggggugcuguccaaaggcaagagagcacucgcaccuccagugaaugaccugaaauauucauggaagacaugggggaaagcaaagaucuuuacuccagaaacaagaaacagcacguuuuugguggacggaccagacaccuccgaaugccccaaugaacgaagagcauggaacuuucuugagguggaagacuauggauuuggcauguucacgaccaacauauggaugaaauuucgagaaggaaguucagaagugugugaccauaggcugaugucggcagcaaucaaagaccagaaagcugugcaugcugacaugggcuauuggauagagagcucaaaaaaccagaccuggcagauagagaaggcaucccucauagaagugaaaacaugucuguggcccaagacccacacauuguggagcaauggagugcuggaaagucagaugcucaucccaaaagcauaugcaggcccuauuucacagcacaacuaucgccagggcuaugccacgcagaccgcaggcccauggcacuugggcaaauuggaaauagacuuuggagaaugccccggaacaacagucacuguacaagaggauugugaccauagaggcccaucuuugagaaccaccacugcaucuggaaaauuggucacgcaguggugcugucgcuccugcacgaugccccccuuaagauuuuuaggagaggauggaugcugguauggaauggaaaucaggcccuugaaugaaaaagaagagaacauggucaaaucacagguuucagccggacaugguacaucagagacuuuuucuauggggcuguugugccugacuuuguuuguggaagaaugcuugaggagaagagucaccaggaaacacaugauauugguuguggugaccacccuuugugccaucauuuuaggaggucuuacauggauggacuuacugcgugcccuuaucaugcuaggggacaccaugucugguagaauggggggacagauucaucuagccaucauggcaguguucaagaugucaccaggauacguguuggguauauuucugaggaaacucaccucaagagagacagcacugaugguaauaggaauggccaugacaacggugcuuucaauuccacaugaccuuauggaauucauugauggaauaucauuaggguuaaucuuauuaaaaaugguaacacauuuugacaacacucaagugggaaccuuagcccuugccuugaccuuuauaaaaucaacaaugccauuggucauggcuuggaggaccauaauggcuguguuguuuguggucacacucauuccucuauguaggacaagcugucuucaaaagcagucccauuggguggaaauaacagcacucauccugggagcccaggcucugccaguauaccuaaugacucucaugaaaggagccucaaaaagaucuuggccccuuaacgaggguauaauggcugugggcuuggucagucucuuaggaagcgcccuucuaaagaaugaugucccuuuagcuggcccaaugguggcaggaggcuuacuucuggcagccuacgugaugagcggcagcucagcagaccugucacuggagaaggcugccaaugugcagugggaugagauggcagacauaacaggcucaagcccaaucauagaagugaagcaggaugaagauggcucuuucuccauacgggacgucgaggaaaccaacaugauuacccuccuggugaaacuggcacugauaacagugucaggucucuaccccuuggcaauuccagucacaaugacccuaugguacauguggcaagugaaaacacaaagaucaggagcccugugggacguccccucaccugcugccgcucagaaagcuacacugacugagggaguauacaggaucaugcaaagaggguuguuuggaaaaacccagguuggaguagggauacacacggaagguguguuucauacaauguggcauguaacaagaggaucagugauuugucaugagagugggagacuggagccaucuugggcugacgucaggaacgacaugauaucauacggugggggauggaggcucggagauaaaugggauaaagaagaagauguucaaguucuagcuauagaaccagggaaaaauccgaaacauguccaaacgaaacccggccucuucaaaacccuuacuggagaaauuggagcaguaacauuggacuucaaacccggaacauccgguucucccaucauuaacaggaaaggaaaagucauuggacucuacggaaaugggguaguuaccaaaucaggugauuacguuagugccauaacacaagcugaaagaauuggugagccagacuaugaaguggaugaggacauuuuccgaaagaaaagauuaacuauaauggauuuacaucccggagccggaaagacaaaaagaauccucccaucaauaguuagagaagccuuaaaaaggaggcugcgaaccuugauucuggcucccacgagagugguggcggccgaaauggaagaagcgcuacguggacugccaauccguuaucagaccccagcugugaaaucagaacacacaggaagagagaucguagaccucaugugucaugcaaccuuuacaacaagacuuuuaucaucaaccaggguuccaaauuacaaccucauagugauggaugaagcgcauuucacagacccuucuaguguugcagcuagaggauauaucucaaccagaguggaaaugggagaggcugcagcuguuuuuaugacugcaaccccuccuggaacgacagaucccuucccccagagcaacagcccaauagaagacaucgagagagaaaucccagaaaggucauggaacacaggguuugacuggauaacggacuaccaagggaaaacugugugguuuguucccagcauaaaagcuggaaaugacauugcaaauugcuugagaaaaucgggaaagaaggucauccaauugagcaggaaaaccuucgauacagaguauccaaaaacgaaacucacggacugggauuuugugauuaccacagacauaucugaaaugggggccaauuuuagagcugggagagugauagaccccaggagaugucucaagccaguuaucuuaacugaugggccagagagaguuauuuuagcuggucccauuccagugacuccagcaagcgccgcucagagaagagggcgaauagguaggaacccagcacaagaagaugaccaguaugucuucuccggagacccacuaaggaaugaugaagaucaugcccacuggacugaagcaaagaugcuucuugauaauaucuacaccccagaagggaucauuccaacacuguuugguccagaaagggaaaaaacccaagccauugacggagaguuccgccucagaggggaacaaaggaagaccuuuguagaacuaaugaggagaggagaccuuccgguguggcugagccacaagguagcuucugcugguaucucuuacaaagaccgggaauggugcuucacgggggaaaggaauaaccaaauuuuggaagaaaacauggagguugaaauuuggacuagggagggagagaagaaaaaacucaggccaaaaugguuagaugcacguguuuacgcugaucccauggcuuugaaggauuucaaggaguuugccaguggaagaaagagcauaacccucgacaucuugacagaaaucgccagucugccaacguaccuuuccuccagggcuaagcucgcccuugacaacauagucaugcuccauacaacagaaagaggagggaaggccuaccaacacgcucugaacgaacucccagagucacuagaaacacucaugcuuguagcuuuauuaggagccaugacagcaggcaucuuccuauucuucaugcaaggaaaaggaaugggaaaauugucaaugggucugauagccauugcgguagcuaguggcuugcucuggguggcagaaauccagccccaauggauagcggccucaaucauauuggaguuuuuucucaugguguuguugguaccagaaccagaaaaacaaaggaccccacaagacaaucaauugaucuacgucauauugaccauucucacuauuauugcucucguggcagccaaugagauggggcuaauugaaaaaacaaaaacggauuuuggguuuuaccaggugaaagcagaaaccaccauccuugauguggacuugagaccagcuucagcauggacgcucuaugcaguagcuaccacuaucuugacccccaugcugaggcacaccauagaaaacacgucugcaaacuuauccuuggcggccauugccaaccaagcagccguccugauggggcuuggaaaaggauggccgcuccacagaauggaccucggugugccgcuauuggcaaugggaugcuauucccaagugaacccaacaacuuuaacagcauccuuggucaugcuucugguccauuaugcaauaauagguccaggauugcaggccaaagccacaagagaggcucaaaaaaggacagcugcugggaucaugaagaaccccacgguggacgggauaacaguuauagaucuagaaccaauauccuaugacccaaaauuugagaagcagcuggggcaagucaugcuacuaguuuugugcguuggacagcuacucuugaugagaacaacaugggccuuuugugaagucuugacuuuggccacaggaccaaucuugaccuugugggaaggcaacccgggaagguuuuggaacacgacaauagccguguccacugccaacauuuucaggggaagcuacuuggcgggagcuggauuggccuuuucgcucauaaagaaugcacaaacccccaggaggggaacugggaccaugggagagacacugggagaaaaauggaagagacagcuaaacucgcuagauaggaaggaguuugaagaguacaaaagaaguggaauacuagaaguggacaggacugaagccaggucugcccuaaaagauggguccaaaaucaaguacgcaguguccagagguaccagcaagauuagauggauuguugaaagagggaugguaaagccaaaagggaaaguuguggaucuugguugcggaaggggaggauggucguacuauauggcgacacucaagaacgugaccgaggugaaaggguauacaaaaggagguccaggacaugaggaaccgauucccauggcuaccuaugguuggaacuuggucaaacuccauucagggguugacguguucuacaaacccacugagcaaguggacacucugcucugugauauuggggagucauccucuaauccgacgauagaggaaggaagaacauuacgaguuuuaaagaugguggagccauggcucucuucaaaaccugaauucugcaucaaaguccucaaucccuacaugccaacagucauagaggagcuggagaaacugcagagacgacaugguggaagucuugucagaugcccgcuauccaggaauuccacucaugagauguauugggugucaggugugucaggaaacaucgugaguucugugaacacaacaucaaagauguuguugaacagauuuaccacaaggcacaggaaacccacuuaugagaaggacgcagaccuuggagcaggaacgagaagugucuccaccgaaacagaaaaaccagacaugacaaucaucgggagaagacuccagcgauugcaagaagagcacaaagaaacuuggcacuaugaucaugaaaauccauacagaaccugggcguaucauggaagcuaugaagcuccuucgacaggcucagcauccuccauggugaacgggguaguuaaacuguugacaaaacccugggacgugguaccaauggugacucaguuggcuaugacagauacaacccccuuugggcaacagagaguguucaaggagaagguugacaccagaacaccacagccaaaaccagguacacaaguagucaugaccacgacagccaacuggcuguggacucuccuugggaggaagaaaaaucccagacugugcacaagggaagaauucaucucaaaaguuaggucaaaugcagccauaggcgcagucuuucaggaagaacagggauggacaucagccagugaagcagugaaugacagccgguuuugggaacugguugacaaagaaagggcucugcaccaggaagggaaaugugaaucaugcgucuauaacaugaugggaaaacgugaaaaaaaauugggagaauuuggcagagccaagggaagccgagcaaucugguacauguggcugggagcgcgguuucuggaauuugaagcccugggcuuuuugaaugaagaucacugguuuggcagggaaaacucauggaguggaguggaaggggaaggucugcauagguugggauacaucuuggaggacauagacaagaaggauggagauuugauauaugcugaugacacagcaggcugggacacaagaaucacugaagaugaccuucugaaugaagagcugaucacggaacagaugaccccucaucauaaaauccuagcuaaagccauuuucaaacuaacuuaucaaaacaaagugguaaaaguccucagacccacaccgaaaggagcagugauggacauuauauccagaaaagaucaaagagguaguggacagguuggaacauaugguuugaacacauucaccaacauggaaguacaacucauccgccaaauggaagcugaaggagucauuacacgagaugacaugcauaacccaaaaggguugaaagaaagaguugagaaauggcugaaagaguguggugucgacagguuaaagaggauggcaauuaguggagacgauuguguggugaagccucuagaugagagguucagcacuucccuccucuuuuugaacgacaugggaaaggugaggaaagacauuccgcaaugggaaccauccaagggauggaaaaacuggcaagagguuccuuuuugcucccaccauuuucacaagaucuuuaugaaggauggccguucacuggucguuccauguagaaaccaggaugaacuaauagggagagcaagaaucucgcaaggggcuggauggaguuuaagagaaacggccugucugggcaaggcuuacgcccagauguggucgcucauguacuuucauagaagggaccuacguuuagccuccauggcuauaugcucagcagucccaacggaaugguuuccaacaaguagaacaacauggucaauccacgcucaucaucaguggaugacuacugaagauaugcuaaaaguguggaacagaguauggauagaagacaacccuaacaugauugacaaaacuccaguucacucgugggaagacauaccuuaccuagggaaaagagaggauuugugguguggauccuugauuggacucucuucuagggccaccugggcuaagaacauucacacagccauaacccaggucaggaaccuaauugggaaagaggaauauguggauuacaugccagccaugagaagauacagcgcucauuucgagagugaaggaguucuguaa

SEQ ID NO: 7905 - RNA, 9867 nt, Artificial Sequence
  derived and/or modified CDS sequence (wt) from DENV-4__KT026309__SS-prME
ucaacaauaacauugcugugcuugauucccacuguaauggcguuucacuugucaacgagagauggugaaccccucaugauaguggcgaaacacgaaagggggagaccucucuuguuuaagacaacagaaggaaucaauaagugcacucuuauugccauggaccugggugagaugugugaggacaccgucacguauaaaugccccuuacuggucaauaccgaacccgaagacauugauugcuggugcaaucucacgucuaccuggguuauguaugggacaugcacccaaaguggagaacgaaggcgagagaagcgcucaguagcucuaacaccacauucaggaaugggauuggaaacaagggcugaaacauggaugucaucggaaggagcuuggaaacacgcccagaggguagagaguuggauacucagaaacccaggauucgcgcucuuggcaggguuuauggccuacaugaucgggcaaacaggaauccagcgaacagucuucuucauucuaaugauguuggucgccccaucuuacggaaugcgaugcguaggaguagggaacagagacuuuguagaaggagucucagguggagcaugggucgaucuggugcuagaacauggaggaugugucacaaccauggcccagggaaagccaaccuuggauuuugaacugauuaagacaacagccaaggaaguggcucuguuaagaaccuauugcauugaagcuuccauaucaaacauaaccacagcaacaagauguccaacgcaaggagagccuuaccucaaagaggaacaagaucaacaguacauuugccggagagacaugguagauagaggguggggcaacgguuguggcuuguuugggaagggaggaguugugacaugugcgaaguuuucaugcuuggggaagauaacgggcaacuuaguucaaauugagaaccuugaauacacagugguuguaacaguccacaauggagacacucacgcuguaggaaaugacacaucuaaccauggagugacagccacaauaacccccaggucaccaucgguugaaguucaauuaccggacuauggagaauugacacucgacugugaaccuagguccggaauugacuuuaaugagaugauucugaugaaaaugaaaacgaaaacguggcucgugcacaagcaaugguuuuuggaucuaccucuaccauggacaacaggagcagacacgcuagaaguucacuggaaucacaaagagagaauggugacauucaagguuccucaugccaagagacaggacgugacagugcuaggaucucaggaaggagccaugcauucagcccucgccggagccacagaaguggacuccggugauggaaaccauauguuugcaggacacuuaaaguguaaaguucguauggaaaaguugaggauuaagggaaugucauacacgaugugcucaggaaaguucucaauugauaaagagauggcagaaacacagcauggaacaacagugguaaaggucaaguaugaggguacuggagcuccauguaaaguucccauagagauaagagaugugaacaaggaaaaagugguugggcgcaucaucucauccaccccuuuugcugagaauaccaacagugugaccaauauagaauuggaaccuccuuuuggggauagcuacauagugauaggugugggagacagugcauuaacacuccauugguucaggaaagggagcuccauuggcaagauguuugaguccacauacagaggugcaaagcgcauggccauucuaggugaaacagcuugggauuuugguuccguugguggacugcucacgucauuaggaaaggcuguacaucaaguuuuuggcaguguguacacaacuauguuuggaggagucucauggauggucagaauccuaaucggacucuuaguguuguggauugguacgaauucaagaaacacuucaauggcuaugucgugcauagcuguuggaggaaucacccuguuucugggcuucacaguccaugcagauauggguuguguggugucauggagugggaaagaguugaaauguggaagcggaaucuuuguaauugacaacgugcacaccuggacagaacaguacaaauuucaaccagagucuccagcgcgacuggcgucggcaauacugaaugcccacaaagaaggggucuguggaauuagaucaaccacgaggcuggaaaaugucauguggaaacaaauaacuaaugaguuaaacuauguucucugggaaggaggacaugaccucacuguaguggccggggaugugaaaggggugcuguccaaaggcaagagagcacucgcaccuccagugaaugaccugaaauauucauggaagacaugggggaaagcaaagaucuuuacuccagaaacaagaaacagcacguuuuugguggacggaccagacaccuccgaaugccccaaugaacgaagagcauggaacuuucuugagguggaagacuauggauuuggcauguucacgaccaacauauggaugaaauuucgagaaggaaguucagaagugugugaccauaggcugaugucggcagcaaucaaagaccagaaagcugugcaugcugacaugggcuauuggauagagagcucaaaaaaccagaccuggcagauagagaaggcaucccucauagaagugaaaacaugucuguggcccaagacccacacauuguggagcaauggagugcuggaaagucagaugcucaucccaaaagcauaugcaggcccuauuucacagcacaacuaucgccagggcuaugccacgcagaccgcgggcccauggcacuugggcaaauuggaaauagacuuuggagaaugccccggaacaacagucacuguacaagaggauugugaccauagaggcccaucuuugagaaccaccacugcaucuggaaaauuggucacgcaguggugcugucgcuccugcacgaugccccccuuaagauuuuuaggagaggauggaugcugguauggaauggaaaucaggcccuugaaugaaaaagaagagaacauggucaaaucacagguuucagccggacauggcacaucagagacuuuuucuauggggcuguugugccugacuuuguuuguggaagaaugcuugaggagaagagucaccaggaaacacaugauauugguuguggugaccacccuuugugccaucauuuuaggaggucuuacauggauggacuuacugcgugcccuuaucaugcuaggggacaccaugucugguagaauggggggacagauucaucuagccaucauggcaguguucaagaugucaccaggauacguguuggguauauuucugaggaaacucaccucaagagagacagcacugaugguaauaggaauggccaugacaacggugcuuucaauuccacaugaccuuauggaauucauugauggaauaucauuaggguuaaucuuauuaaaaaugguaacacauuuugacaacacucaagugggaaccuuagcccuugccuugaccuuuauaaaaucaacaaugccauuggucauggcuuggaggaccauaauggcuguguuguuuguggucacacucauuccucuauguaggacaagcugucuucaaaagcagucccauuggguggaaauaacagcacucauccugggagcccaggcucugccaguauaccuaaugacucucaugaaaggagccucaaaaagaucuuggccccuuaacgaggguauaauggcugugggcuuggucagucucuuaggaagcgcccuucuaaagaaugaugucccuuuagcuggcccaaugguggcaggaggcuuacuucuggcagccuacgugaugagcggcagcucagcagaccugucacuggagaaggcugccaaugugcagugggaugagauggcagacauaacaggcucaagcccaaucauagaagugaagcaggaugaagaugguucuuucuccauacgggacgucgaggaaaccaacaugauuacccuccuggugaaacuggcacugauaacagugucaggucucuaccccuuggcaauuccagucacaaugacccuaugguacauguggcaagugaaaacacaaagaucaggagcccugugggacguccccucaccugcugccgcucagaaagcuacacugacugagggaguauacaggaucaugcaaagaggguuguuuggaaaaacccagguuggaguagggauacacacggaagguguguuucauacaauguggcauguaacaagaggaucagugauuugucaugagagugggagacuggagccaucuugggcugacgucaggaacgacaugauaucauacggugggggauggaggcucggagauaaaugggauaaagaagaagauguucaaguucuagcuauagaaccaggaaaaaauccgaaacauguccaaacgaaacccggccucuucaaaacccuuacuggagaaauuggagcaguaacauuggacuucaaacccggaacauccgguucucccaucauuaacaggaaaggaaaagucauuggacucuacggaaaugggguaguuaccaaaucaggugauuacguuagugccauaacacaagcugaaagaauuggugagccagacuaugaaguggaugaggacauuuuccgaaagaaaagauuaacuauaauggauuuacaucccggagccggaaagacaaaaagaauccucccaucaauaguuagagaagccuuaaaaaggaggcugcgaaccuugauucuggcucccacgagagugguggcggccgaaauggaagaagcgcuacguggacugccaauccguuaucagaccccagcugugaaaucagaacacacaggaagagagaucguagaccucaugugucaugcaaccuuuacaacaagacuuuuaucaucaaccaggguuccaaauuacaaccucauagugauggaugaagcgcauuucacagacccuucuaguguugcagcuagaggauauaucucaaccagaguggaaaugggagaggcugcagcuguuuuuaugacugcaaccccuccuggaacgacagaucccuucccccagagcaacagcccaauagaagacaucgagagagaaaucccagaaaggucauggaacacaggguuugacuggauaacggacuaccaagggaaaacugugugguuuguucccagcauaaaagcuggaaaugacauugcaaauugcuugagaaaaucgggaaagaaggucauccaauugagcaggaaaaccuucgauacagaguauccaaaaacgaaacucacggacugggauuuugugauuaccacagacauaucugaaaugggggccaauuuuagagcugggagagugauagaccccaggagaugucucaagccaguuaucuuaacugaugggccagagagaguuauuuuagcuggucccauuccagugacuccagcaagcgccgcucagagaagagggcgaauagguaggaacccagcacaagaagaugaccaguaugucuucuccggagacccacuaaggaaugaugaagaucaugcccacuggacugaagcaaagaugcuucuugauaauaucuacaccccagaagggaucauuccaacacuguuugguccagaaagggaaaaaacccaagccauugacggagaguuccgccucagaggggaacaaaggaagaccuuuguagaacuaaugaggagaggagaccuuccgguguggcugagccacaagguagcuucugcugguaucucuuacaaagaccgggaauggugcuucacgggggaaaggaauaaccaaauuuuggaagaaaacauagagguugaaauuuggacuagggagggagagaagaaaaaacucaggccaaaaugguuagaugcacguguuuacgcugaucccauggcuuugaaggauuucaaggaguuugccaguggaagaaagagcauaacccucgacaucuugacagaaaucgccagucugccaacguaccuuuccuccagggcuaagcucgcccuugacaacauagucaugcuccauacaacagaaagaggagggaaggccuaccaacacgcucugaacgaacucccagagucacuagaaacacucaugcuuguagcuuuauuaggagccaugacagcaggcaucuuccuauucuucaugcaaggaaaaggaaugggaaaauugucaaugggucugauagccauugcgguagcuaguggcuugcucuggguggcagaaauccagccccaauggauagcggccucaaucauauuggaguuuuuucucaugguguuguugguaccagaaccagaaaaacaaaggaccccacaagacaaucaauugaucuacgucauauugaccauucucacuauuauugcucucguggcagccaaugagauggggcuaauugaaaaaacaaaaacggauuuuggguuuuaccaggugaaagcagaaaccaccauccuugauguggacuugagaccagcuucagcauggacgcucuaugcaguagcuaccacuaucuugacccccaugcugaggcacaccauagaaaacacgucugcaaacuuauccuuggcggccauugccaaccaagcagccguccugauggggcuuggaaaaggauggccgcuccacagaauggaccucggugugccgcuauuggcaaugggaugcuauucccaagugaacccaacaacuuuaacagcauccuuggucaugcuucugguccauuaugcaauaauagguccaggauugcaggccaaagccacaagagaggcucaaaaaaggacagcugcugggaucaugaagaaccccacgguggacgggauaacaguuauagaucuagaaccaauauccuaugacccaaaauuugagaagcagcuggggcaagucaugcuacuaguuuugugcguuggacagcuacucuugaugagaacaacaugggccuuuugugaagucuugacuuuggccacaggaccaaucuugaccuugugggaaggcaacccgggaagguuuuggaacacgacaauagccguguccacugccaacauuuucaggggaagcuacuuggcgggagcuggauuggccuuuucgcucauaaagaaugcacaaacccccaggaggggaacugggaccaugggagagacacugggagaaaaauggaagagacagcuaaacucgcuagauaggaaggaguuugaagaguacaaaagaaguggaauacuagaaguggacaggacugaagccaggucugcccuaaaagauggguccaaaaucaaguacgcaguguccagagguaccagcaagauuagauggauuguugaaagagggaugguaaagccaaaagggaaaguuguggaucuugguugcggaaggggaggauggucguacuauauggcgacacucaagaacgugaccgaggugaaaggguauacaaaaggagguccaggacaugaggaaccgauucccauggcuaccuaugguuggaacuuggucaaacuccauucagggguugacguguucuacaaacccacugagcaaguggacacucugcucugugauauuggggagucauccucuaauccgacgauagaggaaggaagaacauuacgaguuuuaaagaugguggagccauggcucucuucaaaaccugaauucugcaucaaaguccucaaucccuacaugccaacagucauagaggagcuggagaaacugcagagacgacaugguggaagucuugucagaugcccgcuauccaggaauuccacucaugagauguauugggugucaggugugucaggaaacaucgugaguucugugaacacaacaucaaaaauguuguugaacagauuuaccacaaggcacaggaaacccacuuaugagaaggacgcagaccuuggagcaggaacgagaagugucuccaccgaaacagaaaaaccagacaugacaaucaucgggagaagacuccagcgauugcaagaagagcacaaagaaacuuggcacuaugaucaugaaaauccauacagaaccugggcguaucauggaagcuaugaagcuccuucgacaggcucagcauccuccauggugaacgggguaguuaaacuguugacaaaacccugggacgugguaccaauggugacucaguuggccaugacagauacaacccccuuugggcaacagagaguguucaaggagaagguugacaccagaacaccacagccaaaaccagguacacaaguagucaugaccacgacagccaacuggcuguggacucuccuugggaggaagaaaaaucccagacugugcacaagggaagaauucaucucaaaaguuaggucaaaugcagccauaggcgcagucuuucaggaagaacagggauggacaucagccagugaagcagugaaugacagccgguuuugggaacugguugacaaagaaagggcucugcaccaggaagggaaaugugaaucaugcgucuauaacaugaugggaaaacgugaaaaaaaauugggagaauuuggcagagccaagggaagccgagcaaucugguacauguggcugggagcgcgguuucuggaauuugaagcccugggcuuuuugaaugaagaucacugguuuggcagggaaaacucauggaguggaguggaaggggaaggucugcauagguugggauacaucuuggaggacauagacaagaaggauggagauuugauauaugcugaugacacagcaggcugggacacaagaaucacugaagaugaccuucugaaugaagagcugaucacggaacagaugaccccucaucauaaaauccuagcuaaagccauuuucaaacuaacuuaucaaaacaaagugguaaaaguccucagacccacaccgaaaggagcagugauggacauuauauccagaaaagaucaaagagguaguggacagguuggaacauaugguuugaacacauucaccaacauggaaguacaacucauccgccaaauggaagcugaaggagucauuacacgagaugacaugcauaacccaaaaggguugaaagaaagaguugagaaauggcugaaagaguguggugucgacagguuaaagaggauggcaauuaguggagacgauuguguggugaagccucuagaugagagguucagcacuucccuccucuuuuugaacgacaugggaaaggugaggaaagacauuccgcaaugggaaccauccaagggauggaaaaacuggcaagagguuccuuuuugcucccaccauuuucacaagaucuuuaugaaggauggccguucacuggucguuccauguagaaaccaggaugaacuaauagggagagcuagaaucucgcaaggggcuggauggaguuuaagagaaacggccugucugggcaaggcuuacgcccagauguggucgcucauguacuuucauagaagggaccuacguuuagccuccauggcuauaugcucagcagucccaacggaaugguuuccaacaaguagaacaacauggucaauccacgcucaucaucaguggaugacuacugaagauaugcuaaaaguguggaacagaguauggauagaagacaacccuaacaugauugacaaaacuccaguucacucgugggaagacauaccuuaccuagggaaaagagaggauuugugguguggauccuugauuggacucucuucuagggccaccugggcuaagaacauucacacagccauaacccaggucaggaaccuaauugggaaagaggaauauguggauuacaugccagccaugagaagauacagcgcucauuucgagagugaaggaguucuguaa

SEQ ID NO: 7906 - RNA, 9867 nt, Artificial Sequence
  derived and/or modified CDS sequence (wt) from DENV-4__KF907503__SS-prME
ucaacgauaacauugcugugcuugauucccaccguaauggcguuucacuugucaacaagagauggcgaaccccucaugauaguggcaaaacaugaaagggggagaccucucuuguuuaagacaacagaggggaucaacaaaugcacucucauugccauggacuugggugaaaugugugaggacacugucacguauaaaugcccccuacuggucaauaccgaaccugaagacauugauugcuggugcaaccucacgucuaccugggucauguaugggacaugcacccagagcggagaacggagacgagagaagcgcucaguagcuuuaacaccacauucaggaaugggauuggaaacaagagcugagacauggaugucaucggaaggggcuuggaagcaugcucagagaguagagagcuggauacucagaaacccaggauucgcgcucuuggcaggauuuauggcuuauaugauugggcaaacaggaauccagcgaacugucuucuuuguccuaaugaugcuggucgccccauccuacggaaugcgaugcguaggaguaggaaacagagacuuuguggaaggagucucagguggagcaugggucgaccuggugcuagaacauggaggaugcgucacaaccauggcccagggaaaaccaaccuuggauuuugaacugacuaagacaacagccaaggaaguggcucuguuaagaaccuauugcauugaagccucaauaucaaacauaacuacggcaacaagauguccaacgcaaggagagccuuaucugaaagaggaacaggaccaacaguacauuugccggagagaugugguagacagaggguggggcaauggcuguggcuuguuuggaaaaggaggaguugugacaugugcgaaguuuucauguucggggaagauaacaggcaauuugguccaaauugagaaccuugaauacacagugguuguaacaguccacaauggagacacccaugcaguaggaaaugacacauccaaucauggaguuacagccaugauaacucccaggucaccaucgguggaagucaaauugccggacuauggagaacuaacacucgauugugaacccaggucuggaauugacuuuaaugagaugauucugaugaaaaugaaaaagaaaacauggcucgugcauaagcaaugguuuuuggaucugccucuuccauggacagcaggagcagacacaucagagguucacuggaauuacaaagagagaauggugacauuuaagguuccucaugccaagagacaggaugugacagugcugggaucucaggaaggagccaugcauucugcccucgcuggagccacagaaguggacuccggugauggaaaucacauguuugcaggacaucucaagugcaaaguccguauggagaaauugagaaucaagggaaugucauacacgauguguucaggaaaguuuucaauugacaaagagauggcagaaacacagcaugggacaacaguggugaaagucaaguaugaaggugcuggagcuccguguaaaguccccauagagauaagagauguaaacaaggaaaaagugguugggcguaucaucucauccaccccuuuggcugagaauaccaacaguguaaccaacauagaauuagaaccccccuuuggggacagcuacauagugauagguguuggaaacagcgcauuaacacuccauugguucaggaaagggaguuccauuggcaagauguuugaguccacauacagaggugcaaaacgaauggccauucuaggugaaacagcuugggauuuugguuccguugguggacuguucacaucauugggaaaggcugugcaccagguuuuuggaaguguguauacaaccauguuuggaggagucucauggaugauuagaauccuaauuggguucuuaguguuguggauuggcacgaacucaaggaacacuucaauggcuaugacgugcauagcuguuggaggaaucacucuguuucugggcuucacaguucaagcagacauggguuguguggugucauggagugggaaagaauugaaguguggaagcggaauuuuugugguugacaacgugcacacuuggacagaacaguacaaauuucaaccagaguccccagcgagacuagcgucugcaauauuaaaugcccacaaagauggggucuguggaauuagaucaaccacgaggcuggaaaaugucauguggaagcaaauaaccaacgagcuaaacuauguucucugggaaggaggacaugaccucacuguaguggcuggggaugugaaggggguguugaccaaaggcaagagagcacucacacccccagugagugaucugaaauauucauggaagacauggggaaaagcaaaaaucuucaccccagaagcaagaaauagcacauuuuuaauagacggaccagacaccucugaaugccccaaugaacgaagagcauggaacucucuugagguggaagacuauggauuuggcauguucacgaccaacauauggaugaaauuccgagaaggaaguucagaagugugugaccacagguuaaugucagcugcaauuaaagaucagaaagcugugcaugcugacauggguuauuggauagagagcucaaaaaaccagaccuggcagauagagaaagcaucucuuauugaagugaaaacaugucuguggcccaagacccacacacuguggagcaauggagugcuggaaagccagaugcucauuccaaagucauaugcgggcccuuuuucacagcacaauuaccgccagggcuaugccacgcaaaccgugggcccauggcacuuaggcaaauuagagauagacuuuggagaaugccccggaacgacagucacaauucaggaggauugugaccauagaggcccaucuuugaggaccuccacugcaucuggaaaacuagucacgcaauggugcugccgcuccugcacgaugccucccuuaagguucuugggagaagaugggugcugguaugggauggagauuaggcccuugagugaaaaagaagagaacauggucaaaucacaggugacggccggacagggcacaucagaaacuuuuucuaugggucuguugugccugaccuuguuuguggaagaaugcuugaggagaagagucacuaggaaacacaugauauuaguuguggugaucacucuuugugcuaucauccugggaggccucacauggauggacuuacuacgagcccucaucauguugggggacacuaugucugguagaauaggaggacagauccaccuagccaucauggcaguguucaagaugucaccaggauacgugcuggguguguuuuuaaggaaacucacuucaagagagacagcacuaaugguaauaggaauggccaugacaacggugcuuucaauuccacaugaccuuauggaacucauugauggaauaucacugggacuaauuuugcuaaaaauaguaacacaguuugacaacacccaagugggaaccuuagcucuuuccuugacuuucauaagaucaacaaugccauugaucauggcuuggaggaccauuauggcuguguuguuuguggucacacucauuccuuugugcaggacaagcugucuucaaaaacagucucauuggguagaaauaacagcacucauccuaggagcccaagcucugccaguguaccuaaugacucucaugaaaggagccucaagaagaucuuggccucuuaacgagggcauaauggcuguggguuugguuagucucuuaggaagugcucuuuuaaagaaugaugucccuuuagcuggcccaaugguggcaggaggcuuacuucuggcggcuuacgugaugagugguagcucagcagaucugucacuagagaaggccgccaaugugcagugggaugaaauggcagacauaacaggcucaagcccaaucauagaagugaagcaggaugaagauggcucuuucuccauacgggacgucgaggaaaccaauaugauaacccuuuuggugaaacuggcacugauaacagugucaggucucuaccccuuggcaauuccagucacaaugaccuuaugguacauguggcaagugaaaacacaaagaucaggagccuugugggacguccccucacccgcugccacucaaaaagccgcacugucugaaggaguguacaggaucaugcaaagaggguuauucgggaaaacucagguuggaguagggauacacauggaagguguauuucacacaauguggcauguaacaagaggaucagugaucugccacgagacugggagauuggagccaucuugggcugacgucaggaaugacaugauaucauacggugggggauggaggcuuggagacaaaugggacaaagaagaagacguucagguccucgccauagaaccaggaaaaaauccuaaacauguccaaacgaaaccuggccuuuucaagacccuaacuggagaaauuggagcaguaacauuagauuucaaacccggaacgucugguucucccaucaucaacaggaaaggaaaagucaucggacuuuauggaaauggaguaguuaccaaaucaggugauuacgucagugccauaacgcaagccgaaagaauuggagagccagauuaugaaguggaugaggacauuuuucgaaagaaaagauuaacuauaauggacuuacaccccggagcuggaaagacaaaaagaauucuuccaucaauagugagagaagccuuaaaaaggaggcugcgaacuuugauuuuggcucccacgagagugguggcggccgagauggaagaggcccuacguggacugccaauccguuaucagaccccagcugugaaaucagaacacacaggaagagagauuguagaccucaugugucaugcaaccuccacaacaagacuuuugucaucaaccaggguuccaaauuacaaccuuauagugauggaugaagcacauuucacugauccuucuagugucgcggcuagaggauacaucucgaccaggguggaaaugggagaggcagcagccaucuucaugaccgcaaccccucccggagcgacagaucccuuuccccagagcaacagcccaauagaagacaucgagagggaaauuccggaaaggucauggaacacaggguucgacuggauaacagacuaccaagggaaaacugugugguuuguucccagcauaaaagcuggaaaugacauugcaaauuguuugagaaagucgggaaagaaaguuauccaguugaguaggaaaaccuuugauacagaguauccaaaaacgaaacucacggacugggacuuuguggucacuacagacauaucugaaaugggggccaauuuuagagcugggagagugauagacccuagaagaugccucaagccaguuauccuaacagaugggccagagagagucauuuuagcagguccuauuccagugacuccagcaagcgcugcucagagaagagggcgaauaggaaggaacccagcacaagaagacgaccaauacguuuucuccggagacccacuaaaaaaugaugaagaucaugcccacuggacagaagcaaagaugcugcuugacaauaucuacaccccagaagggaucauuccaacauuguuugguccggaaagggaaaaaacccaagccauugauggagaguuucgccucagaggggaacaaaggaagacuuuuguggaauuaaugaggagaggagaccuuccgguguggcugagcuauaagguagcuucugcuggcauuucuuacaaagaucgggaauggugcuucacaggggaaagaaauaaccaaauuuuagaagaaaacauggagguugaaauuuggacuagagagggagaaaagaaaaagcuaaggccaagaugguuagaugcacguguauacgcugaccccauggcuuugaaggauuucaaggaguuugccaguggaaggaagaguauaacucucgacauccuaacagagauugccaguuugccaacuuaccuuuccucuagggccaagcucgcccuugauaacauagucaugcuccacacaacagaaagaggagggagggccuaucaacacgcccugaacgaacuuccggagucacuggaaacacucaugcuuguagcuuugcuaggugcuaugacagcagguaucuuccuguuuuucaugcaagggaaaggaauagggaaauugucaauggguuugauaaucauugcgguggcuaguggcuugcucuggguagcagaaauucaaccccaguggauagcggccucaaucauacuagaguuuuuucucaugguacuguugauaccggaaccagaaaaacaaaggaccccacaagacaaucaauugaucuacgucauauugaccauucucaccaucauuggucuaauagcagccaacgagauggggcugauugaaaaaacaaaaacggauuuuggguuuuaccagguaaaaacagaaaccaccauccucgauguggacuugagaccagcuucagcauggacgcucuaugcaguagccaccacaauucugacucccaugcugagacacaccauagaaaacacgucggccaaccuaucucuagcagccauugccaaccaggcagccguccuaauggggcuuggaaaaggauggccgcuccacagaauggaccucggugugccgcuguuagcaaugggaugcuauucucaagugaacccaacaaccuugacagcauccuuagucaugcuuucaguccauuaugcaauaauaggcccaggauugcaggcaaaagccacaagagaggcccagaaaaggacagcugcugggaucaugaaaaaucccacaguggacgggauaacaguaauagaucuagaaccaauauccuaugacccaaaauuugaaaagcaauuagggcaggucaugcuacuagucuugugugcuggacaacuacucuugaugagaacaacaugggcuuucugugaagucuugacuuuggccacaggaccaaucuugaccuugugggagggcaacccgggaagguuuuggaacacgaccauagccguauccaccgccaacauuuucaggggaaguuacuuggcgggagcuggacuggcuuuuucacucauaaagaaugcacaaaccccuaggaggggaacugggaccacaggagagacacugggagagaaguggaagagacagcuaaacucauuagacagaaaagaguuugaagaguauaaaagaaguggaauacuagaaguggacaggacugaagccaagucugcccugaaagaugggucuaaaaucaagcaugcaguaucuagaggguccaguaagaucagauggauuguugagagagggaugguaaagccaaaagggaaaguuguagaucuuggcugugggagaggaggauggucuuauuacauggcgacacucaagaacgugacugaagugaaaggguauacaaaaggagguccaggacaugaagaaccgauucccauggcuacuuauggcuggaauuuggucaaacuccauucagggguugacguguucuacaaacccacagagcaaguggacacccugcucugugauauuggggagucaucuucuaauccaacaauagaggaaggaagaacauuaagaguuuugaagaugguggagccauggcucucuucaaaaccugaauucugcaucaaaguccuuaaccccuacaugccaacagucauagaagagcuggagaaacugcagagaaaacauggugggaaccuugucagaugcccgcuguccaggaacuccacccaugagauguauugggugucaggagcgucgggaaacauugugagcucugugaacacaacaucaaagauguuguugaacagguucacaacaaggcauaggaaacccacuuaugagaaggacguagaucuuggggcaggaacgagaagugucuccacugaaacagaaaaaccagacaugacaaucauugggagaaggcuucagcgauugcaagaagagcacaaagaaaccuggcauuaugaucaggaaaacccauacagaaccugggcguaucauggaagcuaugaagcuccuucgacaggcucugcauccuccauggugaacgggguaguaaaacugcuaacaaaacccugggaugugauuccaauggugacucaguuagccaugacagauacaaccccuuuugggcaacaaagaguguucaaagagaagguggauaccagaacaccacaaccaaaacccgguacacgaaugguuaugaccacgacagccaauuggcugugggcccuccuuggaaagaagaaaaaucccagacugugcacaagggaagaguucaucucaaaaguuagaucaaacgcagccauaggcgcagucuuucaggaagaacagggauggacaucagccagugaagcugugaaugacagccgguuuugggaacugguugacaaagaaagggcccuacaccaggaagggaaaugugaaucgugugucuauaacaugaugggaaaacgugagaaaaaguuaggagaguuuggcagagccaagggaagccgagcaaucugguacauguggcugggagcgcgguuucuggaauuugaagcccuggguuuuuugaaugaagaucacugguuuggcagagaaaauucauggaguggaguggaaggggaaggucugcacagauugggauauauccuggaggagauagacaagaaggauggagaccuaauguaugcugaugacacagcaggcugggacacaagaaucacugaggaugaccuucaaaaugaggaacugaucacggaacagauggcuccccaccacaagauccuagccaaagccauuuucaaacuaaccuaucaaaacaaaguggugaaaguccucagacccacaccgagaggagcggugauggauaucauauccaggaaagaccaaagagguaguggacaaguuggaacauaugguuugaacacauucaccaacauggaaguucaacucauccgccaaauggaagcugaaggagucaucacacaagaugacaugcagaacccaaaaggguugaaagaaagaguugagaaauggcugaaagaguguggugucgacagguuaaagaggauggcaaucaguggagacgauugcguggugaagccccuagaugagagguucggcacuucccuccucuucuugaacgacaugggaaaggugaggaaagacauuccgcagugggaaccaucuaagggauggaaaaacuggcaagagguuccuuuuugcucccaccacuuucacaagaucuuuaugaaggauggccgcucacuaguuguuccauguagaaaccaggaugaacugauagggagagccagaaucucgcagggggcuggauggagcuuaagagaaacagccugccugggcaaagcuuacgcccagauguggucgcuuauguacuuccacagaagggaucugcguuuagccuccauggccauaugcucagcaguuccaacggaaugguuuccaacaagcagaacaacauggucaauccacgcucaucaccaguggaugaccacugaagauaugcucaaaguguggaacagaguguggauagaagacaacccuaauaugacugacaagacuccaguccauucgugggaagauauaccuuaccuagggaaaagagaggauuugugguguggaucccugauuggacuuucuuccagagccaccugggcgaagaacauucacacggccauaacccaggucaggaaccugaucggaaaagaggaauacguggauuacaugccaguaaugaaaagauacagugcuccuucagagagugaaggaguucuguaa

SEQ ID NO: 7907 - RNA, 9867 nt, Artificial Sequence
  derived and/or modified CDS sequence (wt) from DENV-4__AY947539__SS-prME
ucaacaaugacauugcugugcuugauucccaccgcaauggcguuucacuugucaacaagagauggcgaaccccuuaugauaguggcaagacacgaaagggggagaccucucuuguuuaagacaacagagggaaucaacaaaugcacucuuauugccauggaccugggugaaaugugugaggacaccgucacguaugaaugcccucuacuggucaauaccgaaccugaggacauugauugcuggugcaaucucacgucugccugggucauguaugggacaugcacucagaguggggaacggagacgggagaagcgcucaguagcccuaacaccacauucaggaaugggauuggagacaagggcugagacauggaugucaucggaaggggcuuggaaacaugcucagaggguagagaguuggauacucagaaacccaggauucgcucucuuggcaggauuuauggccuauaugauugggcaaacaggaauccagcgaacagucuucuuuguucuaaugaugcuggucgccccauccuacggaaugcgaugcgugggaguggggaacagagacuuuguggaaggagucucagguggagcaugggucgauuuggugcuagaacauggaggaugugucacaaccauggcccagggaaaaccaaccuuggauuuugaacugaucaagacaacagccaaggaaguggcucuguuaagaaccuauugcauugaagccucgauaucaaacauaaccacggcaacaagauguccaacgcaaggagaaccuuaucucaaagaggaacaagaucaacaguacauuugccggagagaugugguagacagaggguggggcaauggcuguggcuuguuugggaaaggaggaguugugacaugugcgaaguuuucaugcucggggaagauaacaggcaauuugguccaaauugagaaccuugaauacacaguaguuguaacaguccacaauggagacacccaugcaguaggaaaugacauacccaaccauggagugacagccacgauaacccccaggucaccaucgguagaaguuaaauuaccggauuauggagaauuaacacucgauugugaacccagguccggaauugauuuuaaugagaugauucugaugaaaaugaaaaagaaaacguggcuugugcacaagcaaugguuuuuggaucuaccucuaccaugggcagcaggagcagacacaucagaaguucauuggaauuacaaagagagaauggugacauucaagguuccucaugccaagagacaggaugugacagugcuaggaucucaggaaggagccaugcauucugcccucaccggagcuacagaaguggauuccggugauggaaaccacauguuugcaggacaucugaaaugcaaaguucgcauggagaaauugagaauuaagggaaugucauacacgaugugcucaggaaaguucucaauugacaaagagauggcagaaacacagcaugggacaacagugguaaaagucaaguaugagggugcuggagcuccauguaaaguucccauagagauaagagaugugaacaaggaaaaagugguagggcgcaucaucucaucuaccccuuuugcugaguauaccaacaguguaaccaacauagaauuagaaccccccuuuggggacagcuacauaguaauagguguuggagacagugcauuaacacuccauugguucaggaaagggaguuccauuggcaagaugcuugaguccacauacagaggcgcaaagcgaauggccauucuaggugaaacagccugggauuuugguucuguugguggacugcucacaucauugggaaaggcuguacaccagguuuuugguaguguguauacaacuauguuuggaggagucucauggaugguuagaauccuaauuggguucuuaguguuguggauuggcacgaauucgagaaacaccucaauggcaaugacgugcauagcuguuggaggaaucacucuguuucuggguuucacaguucacgcagacacggguugugcggugucauggagugggaaagaauugaaauguggaagcggaaucuuuguaauugacaacgugcacacuuggacagaacaguacaaauuucaaccagagucuccagcgagacuagcguccgcaauauugaaugcccacgaagauggggucuguggaauuagaucaaccacgaggcuggaaaacaucauguggaagcaaauaaccaacgaguugaacuauguucucugggaaggaggacaugaccucacuguaguggccggggaugugaaaggggugcuguccaaaggcaagagagcacucgcacccccagugaaugaucugaaauauucauggaagacauggggaaaagcaaagaucuuuacuccagaagcaaaaaauagcacauuucuaauagacggaccagacaccuccgaaugccccaaugaacgaagagcauggaauuuucuugagguagaagacuauggauuuggcauguuuacgaccaacauauggaugaaauuucgagaaggaaguucagaagugugugaccacagguugaugucggcggcaaucaaagaccagaaagcugugcaugcugacaugggcuauuggauagagagcucaaaaaaccagaccuggcagauagagaaagcaucucucauugaagugaaaacaugucuguggcccaagacccacacauuguggagcaauggagugcuagagagccagaugcucaucccaaaagcauaugcaggcccuuuuucacagcacaauuaccgccagggcuaugccacgcagaccgugggcccauggcacuugggcaaauuggagauagacuuuggagaaugccccggaacaacagucacuauucaagaggauugugaccauagaggcccaucuuugaggaccacuacugcaucuggaaaauuggucacgcaguggugcugccgcuccugcacgaugccucccuuaagguuuuugggagaggauggaugcugguaugggauggaaauuaggcccuugagugaaaaagaagagaacauggucaaaucacagguaucggccggacaggguacaucagaaacuuuuucuauggggcuguuaugccugacuuuguuuguggaagaaugcuugaggagaagagucaccaggaaacacaugauauugguuguggugaccacccuuugugccaucauccuaggaggucucacauggauggacuuacuacgagcucuuaucauguuaggggacaccaugucugguagaaugggaggacagauucacuuagccaucauggcaguguucaagaugucaccaggauacgugcuggguauauuuuuaaggaaacucacuucaagagagacagcacuaauggugauaggaauggccaugacaacggugcuuucaauuccacaugaccuuauggaauucauugauggaauaucacugggguuaaucuuauuaaaaaugguaacacauuuugacaacacucaagugggaaccuuagcucuuuccuugacuuucauaagaucaacaaugccauuggucauggcuuggaggaccauaauggcuguguuguuuguggucacacucauuccuuuaugcaggacaagcugucuucaaaagcagucacauuggguagaaauaacagcacucauccugggagcccaggcucugccaguguaccuaaugacucucaugaaaggagcuucaaagagaucuuggccccuuaacgaggguauaauggcuguggguuuggucagucucuugggaagcgcccuccuaaagaaugaugucccuuuagcuggcccaaugguggcaggaggcuuacuucuggcagccuaugugaugagugguagcucagcagaccugucacuagagaaggccgccaaugugcagugggaugagauggcagacauaacaggcucaagcccaaucauagaagugaagcaggaugaagauggcucuuucuccauacgggacaucgaggaaaccaauaugauaacccucuuagugaaacuggcacugauaacagugucaggucucuaccccuuggcaauuccagucacaaugacccuaugguacauguggcaagugaaaacacaaagaucaggagcccugugggacguccccucaccugcugccgcucagaaagccacacugacugaaggaguguacaggaucaugcaaagaggguuguuugggaaaacucagguuggaguagggauacacauggaagguguauuucacacaauguggcauguaacaagaggaucagugaucugccaugagacugggagacuggagccaucuugggcugacgucaggaacgacaugauaucauacggugggggauggaggcucggagacaaaugggacaaagaagaagauguucagguucuagcuauagaaccaggaaaaaauccgaaacauguccaaacgaagcccggccuuuucaaaacccuaacuggagaaauuggagcagugacauuggacuucaaacccggaacaucugguucucccaucauuaacaggaaaggaaaaguuaucggacucuacggaaauggaguagucacuaaaucaggugauuacgucagugcuauaacgcaagccgaaagaacuggugagccagauuaugaaguggaugaggacauuuuucgaaagaaaagauuaacuauaauggacuuacaccccggagccggaaagacaaaaagaauucucccaucaauagucagagaagccuuaaaaaggaggcugcgaaccuugauuuuggcucccacgagagugguggcggccgagauggaagaggcccuacguggacugccaauccguuaucagaccccagcugugaaaucagaacacacaggaagagagaucguagaccucaugugucaugcaaccuucacaacaagacuuuuaucaucaaccaggguuccaaauuacaaccucauagugauggaugaagcacauuucacagacccuucuagugucgcggcuagaggauacaucucaaccaggguggaaaugggagaggcagcagccaucuuuaugacugcaaccccuccuggagcgacagaucccuucccccagagcaacagcccaauagaagacaucgagagagaaauuccagaaaggucauggaacacaggguucgacuggauaaccgacuaccaagggaaaacugugugguuuguucccagcauaaaagcuggaaaugacauugcaaauugcuugagaaagucgggaaagaaggugauccaauugaguagaaaaaccuuugacacagaguauccaaaaacgaaacuuacggacugggauuuugugguuaccacagacauaucagaaaugggggccaauuuuagagcugggagagugauagaccccaggagaugccucaagccaguuaucucaacugacgggccagagagaguuauuuuggcaggucccauuccagugacuccagcaagcgcugcucagagaagagggcgaauagguaggaacccagcacaagaagaugaccaauaugucuucuccggagacccacuaaaaaaugaugaagaucaugcccacuggacagaagcaaagaugcugcuugauaauaucuacaccccggaagggaucauuccaacauuguuugguccggaaagagaaaaaaaucaagccauugauggagaguuccgccucagaggggaacaaaggaagacuuuuguagaauuaaugaggagaggagaccuuccgguguggcugagcuacaagguagcuucugcugguaucucuuacaaagaccgggaauggugcuucacaggggaaaggaauaaccaaauucuagaagaaaacauggagguugaaauuuggacuagagagggagagaagaaaaaacucaggccaaaaugguuagaugcacguguuuacgcugaccccauggcuuugaaggauuucaaggaguuugccaguggaagaaagagcauaacccucgacauccuaacagagauugccaguuugccaacuuaccuuuccucuagggcuaagcucgcccuugacaacauagucaugcuccacacaacagaaagaggagggaaggccuaccaacaugcccugaacgaacucccggagucacuagaaacacucaugcuuguagcuuuacugggugcuaugacagcaggcaucuucuuguuuuucaugcaaggaaaaggaauagggaaacugucaauggguuugauagccauugcgguagcuaguggcuugcucuggguagcagaaauccagccccaguggauagcggccucaaucauacuagaguucuuucucaugguguuguugauaccagaaccagaaaaacaaaggaccccacaagacaaucaauugaucuacgucauauugaccauucucaccauuauuggucucauagcagccaacgagauggggcugauugaaaaaacaaaaacggauuuuggguuuuaccagguaaaaacagaaaccaccauccucgauguggauuugagaccagccucagcauggacgcucuaugcaguagccaccacuauucugacucccaugcugagacacaccauagaaaacacgucugcaaaccuaucucuagcggccauugcuaaccaagcagcuguccuaauggggcuuggaaaaggauggccgcuccacagaauggaccucggugugccgcuguuggcaaugggaugcuauucucaagugaacccaacgaccuugauagcauccuuagucaugcuuuuaguccauuacgcaauaauagguccaggacugcaggcaaaagccacaagagaggcucagaaaaggacagcagcugggaucaugaagaaccccacuguggacgggauaacaguaauagaucuagaaccaauauccuaugacccaaaauuugaaaagcaauuagggcaagucaugcuacuagucuugugugcuggacagcuacucuugaugagaacaacaugggcuuucugugaagucuugacuuuggccacaggaccagucuugacccugugggagggcaacccgggaagguuuuggaacacgacuauagccguguccacugccaauauuuucaggggaagcuacuuggcgggagcuggacuggccuuuucgcucauaaagaaugcacaaacccccaggaggggaacugggaccacaggagagacacugggagagaaguggaagagacagcuaaacucacuagauaggaaggaguuugaagaguacaaaagaaguggaauacuagaaguggacaggacugaagccaagucugccuugaaagauggaucuaaaaucaagcaugcaguguccagaggguccagcaagauuagauggauuguugaaagagggaugguaaaaccaaaagggaaaguuguggaucuugguugcgggagaggaggauggucguacuacauggcgacacucaagaacgugaccgaggugaaaggguacacaaaaggagguccaggacaugaagaaccgauucccauggcuaccuauggcuggaacuuggucaaacuccauucagggguugacguguucuacaaacccacugagcaaguggauacccugcucugugauauuggggagucaucuucuaauccgacgauagaggaaggaagaacauuaagaguuuugaagaugguggaaccauggcucucuucaaaaccugaauucugcaucaaaguccuuaaucccuacaugccaacagucauagaagagcuggagaaacugcagagaaaacaugguggaagucuugucagaugcccgcuaucuaggaauuccacucacgagauguauugggugucaggugugucgggaaacaucgugagcucuguaaacacaacaucaaagauguuguugaacagauuuaccacaaggcauagaaaacccacuuaugagaaggacguagaccuuggagcaggaacgagaagugucuccacugaaacagaaaaaccggacaugacaaucauugggagaaggcuucagcgacugcaagaagagcacaaagaaacuuggcacuaugaucaggaaaacccauacagaaccugggcguaucauggaagcuaugaagcuccuucgacaggcucagcauccuccauggugaacgggguaguaaaauugcugacaaaacccugggacgugauuccaauggugacccaguuggcuaugacagacacaaccccuuuugggcaacagagaguguuuaaagagaagguggacaccagaacaccacaaccaaaacccggcacacgaaugguuaugaccacgacagccaacuggcugugggcucuccucgggaagaagaaaaaucccagacugugcacaagggaagaguucaucucaaaaguuaggucaaacgcagccauaggcgcagucuuucaggaagaacagggauggacaucagccagugaagcugugaaugacagccgauuuugggaacugguugacaaagaaagggcucugcaccaggaagggaaaugugaaucgugugucuacaacaugaugggaaaacgugagaaaaaguuaggagaguuugguagagccaagggaagccgagcaaucugguacauguggcugggagcgcgguuucuggaauuugaagcccuggguuuuuugaaugaagaucacugguuuggcagagaaaacucauggaguggaguggaaggggaaggucugcauagauugggauauauccuggaggacauagacaagaaggauggagaccugauauaugcugaugacacagcugguugggacacaagaaucacugaagaugaccuucuaaaugaagaacugaucacggaacagauggccccucaccauaagauccuagccaaagccauuuucaaacuaacuuaucaaaacaaaguggugaaaguccucagacccacaccgaaaggagcggugauggauaucauauccaggaaagaccaaagagguaguggacagguuggaacauaugguuugaacacauucaccaacauggaaguacaacucauccgccaaauggaagcugaaggagucaucacacaagaugacaugcauaacccaaaaggguugaaagaaagaguugagaaauggcugaaagaguguggugucgacagguuaaagaggauggcaaucaguggagacgauuguguggugaagccucuggaugagagguucagcacuucccuccucuuuuugaacgacaugggaaaggugaggaaagacauuccgcagugggaaccaucuaagggauggaaaaacuggcaagagguuccuuuuugcucccaccacuuucacaagaucuucaugaaggauggccgcucacuaguuguuccauguagaaaccaggaugaacugauagggagagccagaaucucgcaaggggcuggauggaguuuaagagaaacagccugccugggcaaagcuuacgcccagauguggucgcucauguacuuucauagaagggaccugcguuuagccuccauggcgauaugcucagcaguuccaacagaaugguuuccaacaagcagaacaacauggucaauccacgcccaucaucaguggaugaccacugaagauaugcucaaaguguggaacagaguguggauagaagacaacccuaauaugacugacaagacuccaguucauucgugggaagacauaccuuaccuaggaaaaagagaagauuugugguguggauccuugauuggacuuucuuccagggccaccugggcgaagaacauucacacagccauaacccaggucaggaaccugaucgggaaagaggaguauguggauuacaugccagucaugaaaagauacagcgcuccuuucgagagugaaggaguucuguaa

SEQ ID NO: 7908 - RNA, 9879 nt, Artificial Sequence
  derived and/or modified CDS sequence (opt1) from DENV-1__AB608789__SS-prME
agcgugaccaugcugcucaugcugaugcccaccgcccuggccuuccaccucaccacccggggcggggagccccacaugaucgugaccaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacaucgacugcuggugcaacgccacggacaccugggugaccuacgggaccugcagccagacgggcgagcaccggcgcgacaagcggagcguggcccucgcgccccacgugggccuggggcuggagacccgcaccgagaccuggauguccagcgagggcgccuggaagcagauccagcggguggagacgugggcccuccgccaccccggguucaccgucaucgcccuguuccuggcgcacgccaucggcaccuccaucacccagaaggggaucaucuucauccuccugaugcuggugacgcccagcauggccaugcggugcgugggcaucggcucccgcgacuucgucgaggggcucagcggcgccaccuggguggacgugguccuggagcacggguccugcgugaccaccauggccaaggacaagcccacgcuggacaucgagcuccugaagaccgaggugaccaaccccgcgguccugcggaagcucugcaucgaggccaagaucagcaacaccacgaccgacucccgcugccccacccagggcgaggccacccugguggaggagcaggacgccaacuucgugugccggcgcacguucgucgaccggggcugggggaacggcugcgggcuguucggcaaggggagccucaucacgugcgccaaguucaagugcgugaccaagcuggagggcaagaucgugcaguacgagaaccugaaguacuccgucaucgugaccgugcacacgggcgaccagcaccaggucgggaacgagagcaccgagcacggcaccaccgcgaccaucacgccccaggcccccaccuccgagauccagcucaccgacuacggggcccugacccuggacugcagcccccgcacgggccucgacuucaacgagauggugcugcugaccaugaaggagaaguccuggcucguccacaagcagugguuccuggaccugccgcuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagcgcggguccagcaucggcaagauguucgaggccaccgcccgcggggcccgccgcauggcgauccugggcgacacggccugggacuucggguccaucggcggcguguucaccagcguggggaagcugguccaccagaucuucggcaccgccuacggggugcuguucuccggcgugagcuggaccaugaagaucgggaucggcguccugcugacguggcucggccugaacucccggagcaccucccugagcaugaccugcaucgccguggggcucgugacccuguaccugggcgucauggugcaggccgacuccgggugcgugaucaacuggaagggccgcgagcucaagugcgggagcggcaucuucgucacgaacgaggugcacaccuggaccgagcaguacaaguuccaggcggacagcccgaagcggcuguccgccgccaucggcaaggccugggaggagggggugugcggcauccgcagcgccacccggcuggagaacaucauguggaagcagaucuccaacgagcucaaccacauccugcuggagaacgacaugaaguucaccgucguggugggggacgucgugggcauccucgcgcaggggaagaagaugauccgcccccagcccauggaguacaaguacagcuggaaguccuggggcaaggccaagaucaucggcgccgacgugcagaacacgaccuucaucaucgacgggcccaacaccccggagugccccgacgaccagcgggccuggaacaucugggaggucgaggacuacggcuucgggaucuucaccacgaacaucuggcugaagcugcgcgacagcuacacccaggugugcgaccaccggcucauguccgcggccaucaaggacagcaaggccgugcacgccgacaugggcuacuggaucgaguccgagaagaacgagaccuggaagcuggcccgcgcgagcuucaucgaggucaagaccugcaucuggcccaagucccacacgcuguggagcaacggcgugcucgaguccgagaugaucauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcaaccgcgggccgucccugcggaccaccaccgugacgggcaagaucauccacgaguggugcugccgcagcugcacccugccgccccuccgguucaagggggaggacggcugcugguacgggauggagauccgccccgucaaggagaaggaggagaaccuggugaaguccauggugagcgccggcagcggcgaggucgacuccuucagccucgggcugcugugcauguccaucaugaucgaggaggugaugcggagccgcuggucccggaagaugcucaugaccggcacccuggccguguuccugcuccugaucauggggcagcugacguggaacgaccucauccgccugugcaucauggucggcgccaacgcgagcgaccgcauggggaugggcaccaccuaccuggcccucauggccaccuucaagaugcggccgauguucgccgugggccugcuguuccgccggcucacgucccgcgaggugcugcugcucaccaucgggcugagccuggucgccuccguggagcuccccaacagccuggaggagcugggcgacgggcucgcgaugggcaucaugauccugaagcugcucaccgacuuccagucccaccagcugugggccacccugcucagccugacguucaucaagaccaccgucucccugcacuacgccuggaagaccauggccauggugcucagcaucgugucccuguucccccugugccucagcacgaccucccagaagaccaccuggcugcccguccugcucggcagccuggggugcaagccgcugacgauguuccucaucgcggagaacaagaucuggggccggaaguccuggccccugaacgaggggaucauggccgugggcaucgugagcauccugcucagcucccugcugaagaacgacgucccccucgccgggccccugaucgccggcggcaugcugaucgccugcuacgugaucagcggguccagcgcggaccucucccuggagaaggccgccgaggugagcugggaggaggaggccgagcacuccggcgccagccacaacauccuggucgaggugcaggacgacgggaccaugaagaucaaggacgaggagcgcgacgacacccucaccauccugcugaaggcgacccuccuggccguguccggcgucuacccgcugagcauccccgccacccucuucgugugguacuucuggcagaagaagaagcagcgguccggggugcugugggacacccccagcccgcccgaggucgagcgcgccgugcuggacgagggcaucuaccggaucaugcagcgcggccugcucgggcggucccaggugggcgucgggguguuccaggagaacguguuccacaccauguggcacgucacccgcggcgccgugcugauguaccaggggaagcggcuggagcccagcugggcguccgugaagaaggaccucaucagcuacggcggcggguggcgccugcagggcuccuggaacacgggggaggagguccaggugaucgccguggagcccggcaagaaccccaagaacguccagaccgcccccgggaccuucaagacccccgagggcgaggugggcgccaucgcccuggacuucaagcccgggacgagcggcucccccaucgugaaccgggaggggaagaucgucggccucuacggcaacgggguggugaccaccagcggcaccuacgucagcgcgaucgcccaggccaaggccucccaggaggggccgcugcccgagaucgaggacgagguguuccgcaagcggaaccugacgaucauggaccuccaccccggcagcgggaagacccgccgguaccugccggcgaucgugcgcgaggccaucaagcggaagcugcgcacccucauccuggcccccacccgcgucguggccuccgagauggccgaggcgcugaagggcaugcccauccgguaccagacgaccgccgucaagagcgagcacaccggcaaggagaucgucgaccucaugugccacgccaccuucacgaugcgccugcugucccccgugcgggugccgaacuacaacaugaucaucauggacgaggcccacuucaccgaccccagcuccaucgccgcgcgcggguacaucagcacccgggucggcaugggggaggccgccgccaucuucaugaccgccacgccgcccggcuccguggaggcguucccgcagagcaacgccgugauccaggacgaggagcgcgacauccccgagcgguccuggaacagcggguacgaguggaucaccgacuuccccggcaagaccgucugguucgugcccuccaucaagagcggcaacgacaucgccaacugccuccgcaagaacgggaagcgggugauccagcugucccgcaagaccuucgacacggaguaccagaagaccaagaacaacgacugggacuacgucgugaccaccgacaucagcgagaugggcgccaacuuccgggcggaccgcgugaucgacccgcggcgcugccugaagcccgucauccucaaggacgggcccgagcgggugauccuggccggccccaugccggucacgguggccuccgccgcccagcgccgggggcgcaucggccggaaccacaacaaggagggcgaccaguacaucuacauggggcagccccugaacaacgacgaggaccacgcgcacuggaccgaggccaagaugcuccuggacaacaucaacacccccgagggcaucauccccgcccuguucgagccggagcgcgagaaguccgccgccaucgacggggaguaccgccuccggggcgaggcgcgcaagaccuucguggagcugaugcggcgcggggaccugcccgucuggcucuccuacaagguggccagcgagggcuuccaguacagcgaccggcgcuggugcuucgacggcgagcggaacaaccaggugcuggaggagaacauggacgucgagaucuggacgaaggagggggagcgcaagaagcugcggccccgcuggcucgacgcccggaccuacuccgacccccuggcccugcgcgaguucaaggaguucgccgcgggccggcgcagcguguccggggaccucauccuggagaucggcaagcugccgcagcaccucacccagcgggcccagaacgcccuggacaaccuggugaugcuccacaacagcgagcagggcgggcgcgccuaccggcacgcgauggaggagcugcccgacaccaucgagacgcugaugcuccuggcccugaucgccguccucaccggcggggugacccuguucuuccuguccggccgcgggcucggcaagaccagcaucggccugcugugcgugauggccuccagcguccuccuguggauggccuccguggagccccacuggaucgcggccagcaucauccuggaguucuuccucauggugcugcugauccccgagccggaccggcagcgcacgccccaggacaaccagcucgccuacgucgugaucgggcugcuguucaugauccucacgguggccgccaacgagaugggccugcuggagaccaccaagaaggaccucgggaucggccacgucgcgguggagaaccaccaccacgccaccaugcuggacguggaccugcaccccgccuccgccuggacgcucuacgccgucgcgaccaccaucaucaccccgaugaugcggcacacgaucgagaacaccaccgccaacaucagccugaccgccaucgccaaccaggccgcgauccugauggggcucgacaagggcuggcccaucuccaagauggacaucggcgugccccugcuggcccucgggugcuacagccaggugaacccccugacgcugaccgccgccguccucaugcugguggcgcacuacgccaucaucggcccggggcugcaggccaaggccacccgcgaggcccagaagcgcaccgcggccggcaucaugaagaaccccacgguggacgggaucgucgccaucgaccucgaccccgugguguacgacgccaaguucgagaagcagcugggccagaucaugcugcucauccugugcaccucccagauccugcucaugcggaccaccugggcccugugcgagagcaucacgcuggcgaccggcccccucaccacccugugggagggguccccgggcaaguucuggaacacgaccaucgccgucagcauggccaacaucuuccgcggguccuaccuggccggcgccggccucgcguucagccugaugaagucccucgggggcgggcggcgcgggaccggggcccagggcgagacccucggcgagaaguggaagcggcagcugaaccagcuguccaagagcgaguucaacacguacaagcgcuccgggaucauggagguggaccggagcgaggccaaggagggcgugaagcgcggggagaccaccaagcacgccgucucccggggcaccgcgaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcgggcccggccacgaggagcccaucccgauggccaccuacggguggaaccucgucaagcugcacuccggcaaggacguguucuucacgccgcccgagaagugcgacacgcugcucugcgacaucggggagagcucccccaacccgaccaucgaggagggccggacccugcgcgugcugaagauggucgagcccuggcuccgggggaaccaguucugcaucaagauccugaaccccuacaugcccagcgugguggagacccuggagcagaugcagcgcaagcacggcggcaugcucguccggaacccgcugucccgcaacagcacccacgagauguacuggguguccugcgggacgggcaacaucgugagcgccgucaacaugaccucccggaugcugcucaaccgcuucaccauggcccaccgcaagcccaccuacgagcgggacguggaccugggggcgggcacgcgccacguggccgucgagcccgagguggccaaccuggacaucaucggccagcggaucgagaacaucaagcacgagcacaagagcaccuggcacuacgacgaggacaaccccuacaagaccugggccuaccacggguccuacgaggucaagccgagcggcuccgccagcagcauggugaacgggguggucaagcuccugaccaagcccugggacgugauccccauggugacgcagaucgcgaugaccgacaccacccccuucggccagcagcgcgucuucaaggagaagguggacacgcggaccccgaaggccaagcgcgggaccgcccagaucauggaggugaccgcccgguggcuguggggcuuccucucccgcaacaagaagccccggaucugcacgcgcgaggaguucacccggaagguccgcagcaacgccgcgaucggcgccguguucguggacgagaaccaguggaacuccgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggcccccgagagccgggccaucugguacauguggcugggggcccgcuuccuggaguucgaggcccucggcuucaugaacgaggaccacugguucucccgggagaacagccuguccggcgucgagggggagggccugcacaagcucggguacauccugcgcgacaucagcaagaucccgggcgggaacauguacgcggacgacaccgccggcugggacacgcggaucaccgaggacgaccugcagaacgaggccaagaucaccgacaucauggagcccgagcacgcccuccuggccaccuccaucuucaagcugacguaccagaacaagguggugcgcguccagcgccccgcgaagaacggcaccgugauggacgugaucagccggcgcgaccagcggggguccggccaggucgggaccuacggccucaacaccuucacgaacauggaggcccagcugauccgccagauggagagcgagggcaucuucuccagcuccgagcuggagacccccaaccucgccgagcgggugcuggacuggcuggggaaguacggcguggagcgccucaagcggauggccaucagcggggacgacugcgucgugaagccgaucgacgaccgcuucgccaccgcgcugaccgcccugaacgacgugggcaagguccggaaggacaucccccagugggagcccuccaagggguggaacgacuggcagcagguccccuucugcagccaccacuuccaccagcucaucaugaaggacggccgcgagaucguggucccgugccggaaccaggacgagcuggugggccgcgcccgggugagccagggggccggcuggucccugcgcgagacggccugccucggcaagagcuacgcgcagauguggcagcugauguacuuccaccggcgcgaccugcggcucgccgccaacgccaucugcuccgcgguccccguggacugggugcccaccagccgcaccaccugguccauccacgcccaccaccaguggaugacgaccgaggacaugcugagcgucuggaaccggguguggaucgaggagaaccccuggauggaggacaagacccacguguccagcuggggcgacgucccguaccuggggaagcgcgaggaccaguggugcggcucccucaucggccugaccgcccgcgccaccugggccacgaacauccagguggcgaucaaccaggugcggcgccugaucgggaacgagaacuaccucgacuacaugaccagcaugaagcgguucaagaacgaguccgaccccgagggcgcccugugguga

SEQ ID NO: 7909 - RNA, 9879 nt, Artificial Sequence
  derived and/or modified CDS sequence (opt1) from DENV-1__AB608788__SS-prME
agcgugaccaugcugcucaugcugcugcccaccgugcucgccuuccaccugaccacccggggcggggagccccacaugaucgugaccaagcaggagcggggcaagagccuccuguucaagaccagcgccggggugaacaugugcacgcugaucgcgauggaccugggcgagcucugcgaggacaccaugaccuacaagugcccccgcaucaccgaggccgagcccgacgacguggacugcuggugcaacgccacggacaccugggugaccuacgggaccugcagccagacgggcgagcaccggcgggacaagcggagcguggcccuggcgccccacgucggccuggggcucgagacccgcaccgagaccuggauguccagcgagggcgccuggaagcagauccagcggguggagacgugggcccugcgccaccccggguucaccgugaucgcccuguuccucgcccacgcgaucggcaccuccaucacccagaaggggaucaucuucauccugcugaugcucgugacgcccagcauggccaugcggugcgugggcaucggcaaccgcgacuucguggaggggcuguccggcgccaccugggucgacguggugcuggagcacgggagcugcgucaccaccauggccaaggacaagcccacgcucgacaucgagcugcugaagaccgaggugaccaaccccgccgugcuccggaagcugugcaucgaggcgaagaucuccaacaccacgaccgacagccgcugcccgacccagggcgaggccacccuggucgaggagcaggacgccaacuucgugugccggcgcacguucguggaccggggcugggggaacggcugcggccucuucggcaaggggucccugaucacgugcgccaaguucaagugcgucaccaagcuggagggcaagaucgugcaguacgagaaccucaaguacagcgugaucgucaccgugcacacgggcgaccagcaccaggucgggaacgaguccaccgagcacggcaccaccgccaccaucacgccccaggcgcccaccagcgagauccagcugaccgacuacggggcccugacccucgacugcagcccccggacgggccuggacuucaacgagauggugcugcucaccaugaaggagaaguccuggcuggugcacaagcagugguuccuggaccucccgcugcccuggaccuccggggccaccacgagccaggagaccuggaaccggcaggaccugcucgucaccuucaagaccgcccacgccaagaagcaggagguggugguccugggcagccaggagggcgcgaugcacacggcccugaccggggccaccgagauccagaccuccggcacgaccaccaucuucgccgggcaccucaagugccgccugaagauggacaagcugacccucaagggcaugagcuacgugaugugcacgggguccuucaagcuggagaaggagguggccgagacccagcacggcaccguccugguccaggugaaguacgagggcaccgacgcgcccugcaagauccccuucagcacgcaggacgagaagggggucacccagaacggccgggugaucaccgccaacccgaucgugaccgacaaggagaagcccgucaacaucgaggccgagccgcccuucggggaguccuacaucguggugggcgccggcgagaaggcgcugaagcucagcugguucaagaagggguccacgaucggcaagauguucgaggccaccgcccgcggggcccggcgcauggccauccugggcgacaccgcgugggacuucgggagcaucggcggcgucuucaccuccguggggaagcuggugcaccagaucuucggcacggccuacgggguccucuucagcggcguguccuggaccaugaagaucgggaucggcgugcugcugaccuggcucggccugaacagccgcuccaccagccuguccaugacgugcaucgccgucgggcucgugacccuguaccugggcgugaugguccaggccgacagcggguacgugaucaacuggaagggccgggagcucaagugcggguccggcaucuucgugaccaacgagguccacaccuggaccgagcaguacaaguuccaggccgacagcccgaagcgccuguccgcggccaucggcaaggccugggaggagggggugugcggcauccggagcgccacgcgccuggagaacaucauguggaagcagaucagcaacgagcucaaccacauccugcuggagaacgacaugaaguucaccguggucgugggggacguguccggcauccucgcccaggggaagaagaugauccggccccagcccauggagcacaaguacagcuggaaguccuggggcaaggcgaagaucaucggcgccgacguccagaacagcaccuucaucaucgacgggcccaacaccccggagugccccgacgaccagcgcgccuggaacaucugggagguggaggacuacggcuucgggaucuucacgaccaacaucuggcugaagcugcgggacuccuacacccaggugugcgaccaccgccucaugagcgccgcgaucaaggacuccaaggccguccacgccgacaugggcuacuggaucgagagcgagaagaacgagaccuggaagcuggcccgggccuccuucaucgaggugaagacgugcguguggcccaagagccacacccugugguccaacggcguccucgagagcgagaugaucauccccaagaucuacgggggcccgaucucccagcacaacuaccgccccggguacuucacccagaccagcggccccuggcaccuggggaagcuggagcucgacuucgaccugugcgagggcacgaccgugguggucgacgagcacugcggcaaccgggggccgucccugcgcaccaccacggugaccggcaagaucauccacgaguggugcugccggagcugcacccugccgccccugcgcuucaagggggaggacggcugcugguacgggauggagauccggcccgugaaggagaaggaggagaaccuggucaaguccauggugagcgcgggcagcggcgagguggacuccuucagccucgggcugcugugcaucuccaucaugaucgaggaggucaugcgcagccgguggucccgcaagaugcucaugaccggcacgcuggccguguuccugcuccugaucauggggcagcugaccuggaacgaccucauccggcugugcaucauggucggcgccaacgccagcgaccgcauggggaugggcaccaccuaccuggcccucauggcgacguucaagaugcgcccgauguucgccgugggccugcuguuccggcgccucaccucccgggaggugcugcugcucaccaucgggcugagccuggucgccuccguggagcuccccaacagccuggaggagcugggcgacgggcucgccaugggcaucaugauccugaagcugcucaccgacuuccagucccaccagcugugggccgcgcugcucagccugacguucaucaagaccaccuucucccugcacuacgccuggaagaccauggccauggugcucagcaucgucucccuguucccccugugccucagcacgaccucccagaagaccaccuggcugcccgugcugcucggcagccuggggugcaagccgcugacgauguuccucaucgccgagaacaagaucuggggccgcaaguccuggccccugaacgaggggaucauggcggugggcaucgucagcauccugcucagcucccugcugaagaacgacgugccccucgccgggccccugaucgccggcggcaugcugaucgccugcuacgugaucagcggguccagcgccgaccucucccuggagaaggcggccgaggucagcugggaggaggaggccgagcacuccggcgccagccacaacauccugguggaggugcaggacgacgggaccaugaagaucaaggacgaggagcgggacgacacccucaccauccugcugaaggccacccuccuggcggucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgccgugcugauguaccaggggaagcgccuggagcccagcugggccuccgucaagaaggaccucaucagcuacggcggcggguggcggcugcagggcuccuggaacacgggggaggagguccaggugaucgcggucgagcccggcaagaaccccaagaacgugcagaccgcccccgggaccuucaagacccccgagggcgaggugggcgccaucgcccuggacuucaagcccgggacgagcggcucccccaucgucaaccgcgaggggaagaucgugggccucuacggcaacgggguggucaccaccagcggcaccuacgugagcgccaucgcgcaggccaaggccucccaggaggggccgcugcccgagaucgaggacgagguguuccggaagcgcaaccugacgaucauggaccuccaccccggcagcgggaagacccggcgcuaccugccggccaucguccgggaggcgaucaagcgcaagcugcggacccucauccuggcccccacccgcgugguggccuccgagauggccgaggcccugaagggcaugcccauccgcuaccagacgaccgcggucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgccgcccggggguacaucagcacccgcgugggcaugggggaggcggccgccaucuucaugaccgccacgccgcccggcuccguggaggccuucccgcagagcaacgcggucauccaggacgaggagcgggacauccccgagcgcuccuggaacagcggguacgacuggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggucaccaccgacaucagcgagaugggcgccaacuuccgcgccgaccgggugaucgacccgcgccggugccugaagcccgugauccucaaggacgggcccgagcgcgucauccuggcgggccccaugccggugacgguggccuccgccgcccagcggcgcgggcggaucggccgcaaccagaacaaggagggcgaccaguacaucuacauggggcagccccugaacaacgacgaggaccacgcccacuggaccgaggcgaagaugcuccuggacaacaucaacacccccgagggcaucauccccgcccuguucgagccggagcgggagaaguccgccgccaucgacggggaguaccgccuccgcggcgaggcccggaagaccuucgucgagcugaugcgccgcggggaccugcccguguggcucuccuacaagguggcgagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgccgccggccgccggagcguguccggggaccucauccuggagaucggcaagcugccgcagcaccucacccagcgcgcgcagaacgcccuggacaaccuggucaugcuccacaacagcgagcagggcgggcgggccuaccgccacgccauggaggagcugcccgacaccaucgagacgcugaugcuccuggcgcugaucgccgugcucaccggcggggugacccuguucuuccuguccggccgggggcucggcaagaccagcaucggccugcugugcgucauggccuccagcgugcuccuguggauggccuccguggagccccacuggaucgccgcgagcaucauccuggaguucuuccucaugguccugcugauccccgagccggaccgccagcggacgccccaggacaaccagcucgccuacguggugaucgggcugcuguucaugauccucacggucgccgccaacgagaugggccugcuggagaccaccaagaaggaccucgggaucggccacguggccguggagaaccaccaccacgcgaccaugcuggacgucgaccugcaccccgccuccgccuggacgcucuacgccguggccaccaccaucaucaccccgaugaugcgccacacgaucgagaacaccaccgcgaacaucagccugaccgccaucgccaaccaggccgccauccugauggggcucgacaagggcuggcccaucuccaagauggacaucggcgugccccugcuggcgcucgggugcuacagccaggucaacccccugacgcugaccgccgccgugcucaugcugguggcccacuacgcgaucaucggcccggggcugcaggccaaggccacccgggaggcccagaagcgcaccgccgcgggcaucaugaagaaccccacggucgacgggaucguggccaucgaccucgaccccguggucuacgacgccaaguucgagaagcagcugggccagaucaugcugcucauccugugcaccucccagauccugcucaugcgcaccaccugggcccugugcgagagcaucacgcuggccaccggcccccucaccacccugugggagggguccccgggcaaguucuggaacacgaccaucgcggugagcauggccaacaucuuccggggguccuaccuggccggcgccggccucgccuucagccugaugaagucccucgggggcgggcgccgggggaccggggcgcagggcgagacccucggcgagaaguggaagcgccagcugaaccagcuguccaagagcgaguucaacacguacaagcgguccgggaucaucgagguggaccgcagcgaggccaaggagggccucaagcgcggggagaccaccaagcacgccgucucccgcggcaccgccaagcugcggugguucguggagcgcaaccuggugaagcccgaggggaaggucaucgaccugggcugcggccgcggcggguggagcuacuacugcgcggggcucaagaaggugacggaggugaagggguacaccaagggcggggccggccacgaggagcccauccccauggccaccuacggguggaaccuggucaagcuguacuccggcaaggacguguucuucaccccgcccgagaagugcgacacgcuccugugcgacaucggggagagcucccccaaccccaccaucgaggagggccgcacccugcgggugcucaagauggucgagccguggcugcgcgggaaccaguucugcaucaagauccugaaccccuacaugcccagcgugguggagacccucgagcagaugcagcggaagcacggcggcaugcugguccgcaacccccugucccggaacagcacccacgagauguacuggguguccugcgggacgggcaacaucgugagcgccgucaacaugaccucccgcaugcuccugaaccgguucaccauggcccaccgcaagccgaccuacgagcgcgacguggaccugggggcgggcacgcggcacgucgccguggagcccgagguggccaaccucgacaucaucggccagcgcaucgagaacaucaagcacgagcacaagagcaccuggcacuacgacgaggacaaccccuacaagaccugggccuaccacggguccuacgaggucaagcccagcggcuccgccagcagcauggugaacggggugguccggcugcugaccaagccgugggacgugauccccauggugacgcagaucgcgaugaccgacaccacccccuucggccagcagcgcgucuucaaggagaagguggacacgcggacccccaaggccaagcaggggaccgcccaggugauggaggucaccgcccgcuggcucuggggcuuccugucccggaacaagaagccgcgcaucugcacgcgggaggaguucacccgcaaggugcggagcaacgccgcgaucggcgccguguucgucgacgagaaccaguggaacuccgccaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggccaaggggagccgcgccaucugguacauguggcugggcgcccgguuccucgaguucgaggcccugggcuucaugaacgaggaccacugguucucccgcgagaacagccuguccgggguggagggcgaggggcuccaccggcugggcuacauccugcgcgacaucagcaagauccccgggggcaacauguacgcggacgacaccgccggcugggacacgcggaucaccgaggacgaccuccagaacgaggccaagaucaccgacaucauggagcccgagcacgcccugcuggccaccuccaucuucaagcucacguaccagaacaaggugguccgcgugcagcgcccggcgaagaacgggaccgugauggacgucaucagccggcgcgaccagcggggcuccggccaggugggcaccuacggccugaacaccuucacgaacauggaggcccagcugauccgccagauggagagcgaggggaucuucucccccagcgagcucgagacccccaaccuggccgagcgggugcuggacuggcucgagaaguacggcgucgagcgccugaagcggauggccaucuccggggacgacugcguggugaagcccaucgacgaccgcuucgccaccgcgcugaccgcccucaacgacaugggcaagguccggaaggacaucccgcagugggagcccagcaagggguggaacgacuggcagcagguccccuucugcucccaccacuuccaccagcugaucaugaaggacggccgcgagaucgugguccccugccggaaccaggacgagcuggugggccgcgcccgggugagccagggggccggcuggagccuccgcgagacggccugccuggggaaguccuacgcgcagauguggcagcugauguacuuccaccggcgcgaccuccggcuggccgccaacgccaucugcagcgcggucccgguggacugggugcccaccucccgcaccaccuggagcauccacgcccaccaccaguggaugacgaccgagaacaugcuguccgucuggaaccggguguggaucgaggagaaccccuggauggaggacaagacccacgugagcuccugggaggacguccccuaccucggcaagcgcgaggaccaguggugcgggagccugaucggccugaccgcccgcgccaccugggccacgaacauccagguggcgaucaaccaggugcggcgccucaucggcaacgagaacuaccuggacuacaugaccuccaugaagcgguucaagaacgacagcgacccggagggggcccugugguga

SEQ ID NO: 7910 - RNA, 9879 nt, Artificial Sequence
  derived and/or modified CDS sequence (opt1) from DENV-1__AB608786__SS-prME
agcgugaccaugcugcucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccacggacaccugggugaccuacgggaccugcagccagacgggcgagcaccggcgcgacaagcgguccguggcccucgcgccccacgugggccuggggcuggagacccgcaccgagaccuggaugagcuccgagggcgcguggaagcagauccagcgggucgagacgugggcccuccgccaccccggguucaccgugaucgcccuguuccuggcccacgugaucggcaccagcaucacccagaaggggaucaucuucauccuccugaugcuggucacgcccucccucgcgaugcggugcgugggcaucggcagccgcgacuucguggaggggcuguccggcgccaccugggucgacguggugcuggagcacgggagcugcgucaccaccauggccaaggacaagcccacgcucgacaucgagcugcugaagaccgaggugaccaaccccgccgugcuccggaagcugugcaucgaggccaagaucuccaacaccacgaccgacagccgcugcccgacccagggcgaggcgacccuggucgaggagcaggacgccaacuucgugugccggcgcacguucguggaccggggcugggggaacggcugcgggcuguucggcaaggggucccugaucacgugcgccaaguucaagugcgucaccaagcuggagggcaagaucgugcaguacgagaaccucaaguacagcgugaucgucaccgugcacacgggcgaccagcaccaggucgggaacgaguccaccgagcacggcaccaccgccaccaucacgccccaggcccccaccaccgagauccagcugaccgacuacggggcgcugacgcucgacugcagcccccgcaccggccuggacuucaacgagauggugcugcucaccaugaaggagaaguccuggcuggugcacaagcagugguuccuggaccucccccugcccuggaccagcggggccagcacgucccaggagaccuggaaccggcaggaccugcucgucaccuucaagaccgcccacgccaagaagcaggagguggugguccugggcagccaggagggcgccaugcacacggcgcugaccggggccaccgagauccagaccuccggcacgaccaccaucuucgccgggcaccucaagugccgccugaagauggacaagcugacccucaagggcaugagcuacgugaugugcacgggguccuucaagcuggagaaggagguggccgagacccagcacggcaccguccuggugcagaucaaguacgagggcaccgacgcccccugcaagauccccuucagcacgcaggacgagaagggggugacccagaacggccggcugaucaccgcgaacccgaucgucaccgacaaggagaagcccgugaacaucgaggccgagccgcccuucggggaguccuacaucaucaucggcgccggcgagaaggcccucaagcugagcugguucaagaagggguccagcaucggcaagauguucgaggcgacggcccgcggggcccggcgcauggccauccugggcgacaccgccugggacuucggguccaucggcggcguguucaccagcgucgggaagcucgugcaccagaucuucggcaccgcguacggggugcuguucuccggcgucagcuggacgaugaagaucgggaucggcgugcugcucaccuggcugggccugaacucccgcagcaccucccucagcaugaccugcaucgccguggggcuggucacgcuguaccucggcgugauggugcaggccgacuccgggugcgucaucaacuggaagggccgggagcugaagugcgggagcggcaucuucgugaccaacgaggugcacaccuggaccgagcaguacaaguuccaggccgacagcccgaagcgccuguccgccgcgaucggcaaggccugggaggagggggucugcggcauccggagcgccacccgccucgagaacaucauguggaagcagaucuccaacgagcugaaccacauccugcucgagaacgacaugaaguucacggugguggucggggacguggccggcauccuggcccaggggaagaagaugauccggccccagcccauggaguacaaguacagcuggaaguccuggggcaaggcgaagaucaucggcgccgacgugcagaacaccaccuucaucaucgacgggcccaacaccccggagugccccgacgaccagcgcgccuggaacaucugggaggucgaggacuacggcuucgggaucuucacgaccaacaucuggcugaagcuccgggacagcuacacccaggugugcgaccaccgccugauguccgccgcgaucaaggacagcaaggccgugcacgccgacaugggcuacuggaucgaguccgagaagaacgagaccuggaagcuggcccgggccagcuucaucgaggucaagacgugcaucuggcccaagucccacacccucuggagcaacggcgugcuggaguccgagaugaucauccccaagaucuacgggggcccgaucagccagcacaacuaccgccccggguacuucacccagaccgcgggccccuggcaccuggggaagcucgagcuggacuucgaccugugcgagggcacgaccguggucguggacgagcacugcggcaaccgggggccgucccuccgcaccaccacggugaccggcaagaucauccacgaguggugcugccggagcugcacccugccgccccugcgcuuccgcggggaggacggcugcugguacgggauggagauccgccccgucaaggagaaggaggagaaccucgugaaguccauggugagcgccggcagcggcgaggucgacuccuucagccuggggcugcucugcaucuccaucaugaucgaggaggugaugcggagccgcuggucccggaagaugcugaugaccggcacgcuggccguguucuuccuccugaucauggggcagcugaccuggaacgaccucauccgccugugcaucauggucggcgccaacgccagcgaccgcauggggaugggcaccaccuaccuggcgcucauggccacguucaagaugcggccgauguucgccgugggccugcuguuccgccggcucaccucccgcgaggugcugcugcucaccaucgggcugagccuggucgccuccguggagcuccccaacagccuggaggagcugggcgacgggcucgccaugggcaucaugauccugaagcugcucaccgacuuccagucccaccagcugugggcgacgcugcucagccugaccuucaucaagaccaccuucucccugcacuacgccuggaagacgauggccaugguccucagcaucgugucccuguucccccugugccucagcaccaccucccagaagaccacguggcugcccgugcugcucggcagccuggggugcaagccgcugaccauguuccucaucgccgagaacaagaucuggggccggaaguccuggccccugaacgaggggaucauggcggucggcaucgugagcauccugcucagcucccugcugaagaacgacgugccccucgccgggccccugaucgccggcggcaugcugaucgccugcuacgucaucagcggguccagcgccgaccucucccuggagaaggcggccgaggugagcugggaggaggaggccgagcacuccggcgccagccacaacauccugguggagguccaggacgacgggaccaugaagaucaaggacgaggagcgcgacgacacccucaccauccugcugaaggccacgcuccuggcgguguccggcguguacccgcugagcauccccgccacccucuucgucugguacuucuggcagaagaagaagcagcgguccggggugcugugggacacccccagcccgcccgagguggagcgcgccguccuggacgacggcaucuaccggaucaugcagcgcggccugcucgggcggucccaggugggcgugggggucuuccaggagaacguguuccacaccauguggcacgugacgcgcggcgccguccugauguaccaggggaagcggcuggagcccagcugggccuccgugaagaaggaccucaucagcuacggcggcggguggcgccugcagggcuccuggaacaccggggaggaggugcaggucaucgcgguggagcccggcaagaaccccaagaacgugcagaccgcccccgggaccuucaagacgcccgagggcgaggucggcgccaucgcccuggacuucaagcccgggaccagcggcucccccaucgugaaccgggaggggaagaucgugggccucuacggcaacggggucgugaccaccagcggcacguacgugagcgccaucgcgcaggccaaggccucccaggaggggccgcugcccgagaucgaggacgaggucuuccgcaagcggaaccugaccaucauggaccuccaccccggcagcgggaagacccgccgguaccugccggccaucgugcgcgaggcgaucaagcggaagcugcgcacccucauccuggcccccacgcgcguggucgccuccgagauggccgaggcccugaagggcaugcccauccgguaccagaccaccgcggucaagagcgagcacaccggcaaggagaucguggaccucaugugccacgccacguucaccaugcgccugcugucccccguccgggugccgaacuacaacaugaucaucauggacgaggcccacuucaccgaccccagcuccaucgccgcccgcggguacaucagcacccgggugggcaugggggaggcggccgccaucuucaugacggccacgccgcccggcuccgucgaggccuucccgcagagcaacgcggugauccaggacgaggagcgcgacauccccgagcgguccuggaacagcggguacgaguggaucaccgacuuccccggcaagaccgugugguucguccccuccaucaagagcggcaacgacaucgccaacugccuccgcaagaacgggaagcgggugauccagcugucccgcaagacguucgacaccgaguaccagaagaccaagaacaacgacugggacuacguggucaccacggacaucagcgagaugggcgccaacuuccgggccgaccgcgugaucgacccgcggcgcugccugaagcccgugauccucaaggacgggcccgagcgggucauccuggcgggccccaugccggugaccgucgccuccgccgcccagcgccgggggcgcaucggccggaaccacaacaaggagggcgaccaguacaucuacauggggcagccccugaacaacgacgaggaccacgcccacuggaccgaggcgaagaugcuccuggacaacaucaacacccccgagggcaucauccccgcccuguucgagccggagcgcgagaaguccgccgccaucgacggggaguaccgccuccggggcgaggcccgcaagacguucguggagcugaugcggcgcggggaccugcccguguggcucuccuacaaggucgcgagcgagggcuuccaguacagcgaccggcgcuggugcuucgacggcgagcggaacaaccaggugcuggaggagaacauggacguggagaucuggaccaaggagggggagcgcaagaagcugcggccccgcuggcucgacgcccggaccuacuccgacccccuggcccugcgcgaguucaaggaguucgccgccggccggcgcagcgucuccggggaccucauccuggagaucggcaagcugccgcagcaccucacccagcgggcgcagaacgcccuggacaaccuggugaugcuccacaacagcgagcagggcgggcgcgccuaccggcacgccauggaggagcugcccgacacgaucgagacccugaugcuccuggcgcugaucgccgugcucaccggcggggucacccuguucuuccuguccggccgcgggcucggcaagaccagcaucggccugcugugcgugauggccuccagcgugcuccuguggauggccuccgucgagccccacuggaucgccgcgagcaucauccuggaguucuuccucauggugcugcugauccccgagccggaccggcagcgcacgccccaggacaaccagcucgccuacguggucaucgggcugcuguucaugauccucaccguggccgccaacgagaugggccugcuggagaccaccaagaaggaccucgggaucggccacguggccgucgagaaccaccaccacgcggccaugcuggacguggaccugcaccccgccuccgccuggacgcucuacgccguggcgaccaccaucaucaccccgaugaugcggcacacgaucgagaacaccaccgccaacaucagccugaccgccaucgccaaccaggccgcgauccugauggggcucgacaagggcuggcccaucuccaagauggacaucggcgucccccugcuggcccucgggugcuacagccaggugaacccccugacgcugaccgccgccgugcucaugcuggucgcgcacuacgccaucaucggcccggggcugcaggccaaggccacccgcgaggcccagaagcgcaccgcggccggcaucaugaagaaccccacgguggacgggaucguggccaucgaccucgaccccgucguguacgacgccaaguucgagaagcagcugggccagaucaugcugcucauccugugcaccucccagauccugcucaugcggaccaccugggcccugugcgagagcaucacgcuggcgaccggcccccucaccacccugugggagggguccccgggcaaguucuggaacacgaccaucgccgugagcauggccaacaucuuccgcggguccuaccuggccggcgccggccucgcguucagccugaugaagucccucgggggcgggcggcgcgggaccggggcccagggcgagacccucggcgagaaguggaagcggcagcugaaccagcuguccaagagcgaguucaacacguacaagggguccggcaucauggaggucgaccgcagcgaggccaaggaggggcucaagcggggcgagaccaccaagcacgccgugucccgcgggaccgcgaagcugcggugguucguggagcgcaaccuggucaagcccgagggcaaggugaucgaccugggcugcgggcggggcggguggagcuacuacugcgccggccucaagaaggugacggaggucaagggguacaccaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgacgaucgaggaggggcgcacccugcggguccucaagaugguggagcccuggcugcgcggcaaccaguucugcaucaagauccugaaccccuacaugcccagcguggucgagacccucgagcagaugcagcggaagcacggcgggaugcuggugcgcaacccgcugucccggaacagcacccacgagauguacuggguguccugcggcaccgggaacaucgucagcgccgugaacaugacgucccgcaugcuccugaaccgguucaccauggcccaccgcaagcccaccuacgagcgcgacguggaccugggcgcgggcacccggcacgucgccguggagcccgagguggccaaccucgacaucaucgggcagcgcaucgagaacaucaagcacgagcacaagagcacguggcacuacgacgaggacaaccccuacaagaccugggccuaccacggcuccuacgaggucaagccgagcggguccgccagcagcauggugaacggcgucgugaagcugcugaccaagcccugggacgugauccccauggucacccagaucgcgaugacggacaccacccccuucgggcagcagcggguguucaaggagaagguggacacccgcacgccgaaggccaagcggggcaccgcccagaucauggaggucaccgccaaguggcucuggggcuuccugucccgcaacaagaagccccggaucugcacccgcgaggaguucacgcggaaggugcgcagcaacgccgcgaucggggccguguucgucgacgagaaccaguggaacuccgccaaggaggccguggaggacgagcgguucugggaccuggugcaccgcgagcgggagcuccacaagcagggcaagugcgcgaccugcgucuacaacaugauggggaagcgcgagaagaagcugggcgaguucgggaaggccaagggcagccgggccaucugguacauguggcugggcgcccgcuuccucgaguucgaggcccugggguucaugaacgaggaccacugguucucccgggagaacagccuguccggcguggagggggagggccuccacaagcugggguacauccugcgcgacaucagcaagauccccggcggcaacauguacgcggacgacaccgccgggugggacacccggaucacggaggacgaccuccagaacgaggccaagaucaccgacaucauggagccggagcacgcccugcuggccaaguccaucuucaagcucaccuaccagaacaaggugguccgcgugcagcggcccgcgaagaacggcaccgugauggacgucaucagccgccgcgaccagcggggguccggccaggugggcacguacgggcugaacaccuucaccaacauggaggcccagcugauccgccagauggagagcgagggcaucuucucccccagcgagcucgagacccccaaccuggccgagcgggugcuggacuggcucgagaaguacggggucgagcgccugaagcggauggccaucuccggcgacgacugcguggugaagccgaucgacgaccgcuucgccacggcgcugaccgcccucaacgacauggggaagguccggaaggacaucccccagugggagcccagcaagggcuggaacgacuggcagcagguccccuucugcucccaccacuuccaccagcugaucaugaaggacggccgcgagaucguggucccgugccggaaccaggacgagcugguggggcgcgcccgggugagccagggcgccggguggagccuccgcgagaccgccugccugggcaaguccuacgcgcagauguggcagcugauguacuuccaccggcgcgaccuccggcuggccgccaacgccaucugcagcgcgguccccguggacugggugcccaccucccgcacgaccuggagcauccacgcccaccaccaguggaugaccaccgaggacaugcuguccgucuggaaccggguguggaucgaggagaaccccuggauggaggacaagacgcacaucagcuccuggggcgacgugccguaccucggcaagcgcgaggaccaguggugcggcagccugaucgggcugaccgcccgggccaccugggccaccaacauccaggucgcgaucaaccaggugcgccgccucaucggcaacgagaacuaccuggacuacaugaccuccaugaagcgguucaagaacgagagcgaccccgagggggcccugugguga

SEQ ID NO: 7911 - RNA, 9879 nt, Artificial Sequence
  derived and/or modified CDS sequence (opt1) from DENV-1__AB608787__SS-prME
agcgugaccaugcugcucaugcugaugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccggcgaccagcaccagguggggaacgaguccacggagcacggcaccaccgcgaccaucacgccccaggcccccacgaccgagauccagcugaccgacuacggggcccugacccucgacugcagcccccgcacgggccuggacuucaacgagaugguccugcucaccaugaaggagaaguccuggcuggugcacaagcagugguuccuggaccucccccugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccgacuccgggugcgucaucaacuggaagggccgggagcugaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccucgagaacaucauguggaagcagaucuccaacgagcugaaccacauccugcucgagaacgacaugaaguucaccgugguggucggggacguggcgggcauccuggcccaggggaagaagaugauccggccccagcccauggagcacaaguacagcuggaaguccuggggcaaggccaagaucaucggcgccgacgugcagaacagcacguucaucaucgacgggcccaacaccccggagugccccgacgaccagcgcgcguggaacaucugggaggucgaggacuacggcuucgggaucuucaccaccaacaucuggcugaagcuccgggacuccuacacccaggugugcgaccaccgccugaugagcgccgccaucaaggacuccaaggccgugcacgccgacaugggcuacuggaucgagagcgagaagaacgagaccuggaagcuggcgcgggccuccuucaucgaggucaagaccugcaucuggcccaagagccacacccucugguccaacggcgugcuggagagcgagaugaucauccccaagaucuacgggggcccgaucucccagcacaacuaccgccccggguacuucacgcagaccgccggccccuggcaccuggggaagcucgagcuggacuucgaccugugcgagggcaccaccguggucguggacgagcacugcggcaaccgggggccgagccuccgcacgaccaccgugaccggcaagaucguccacgaguggugcugccgguccugcacgcugccgccccugcgcuuccgcggggaggacggcugcugguacgggauggagauccgccccgugaaggagaaggaggagaaccucgucaagagcauggucagcgccggcuccggcgagguggacagcuucucccuggggcugcucugcaucagcaucaucaucgaggaggugaugcggucccgcuggauccggaagaugcugaugaccggcacccugggggucuucuuccuccugaucaugggccagcugaccuggaacgaccucauccgccugugcaucauggugggggccaacgcgagcgaccgcaugggcaugggcacgaccuaccuggcccucauggccaccuucaagaugcggccgauguucgccguggggcugcuguuccgccggcucaccucccgcgagguccugcugcucacgaucggccugagccugguggccuccgucgagcuccccaacagccuggaggagcugggggacggccucgcgaugggcaucaugauccugaagcugcucaccgacuuccagucccaccagcugugggccacccugcucagccugaccuucaucaagacgaccuucucccugcacuacgccuggaagaccauggccauggugcucagcaucgugucccuguucccccugugccucagcaccacgucccagaagaccaccuggcugcccguccugcucgggagccugggcugcaagccgcugaccauguuccucaucgcggagaacaagaucugggggcggaaguccuggccccugaacgagggcaucauggccguggggaucgugagcauccugcucagcucccugcugaagaacgacgucccccucgccggcccccugaucgccggcgggaugcugaucgccugcuacgugaucagcggcuccagcgcggaccucucccuggagaaggccgccgaggugagcugggaggaggaggccgagcacuccggggccagccacaacauccuggucgaggugcaggacgacggcacgaugaagaucaaggacgaggagcgcgacgacacccucaccauccugcugaaggcgacccuccuggccguguccggggucuacccgcugagcauccccgccacccucuucgugugguacuucuggcagaagaagaagcagcgguccggcgugcugugggacacgcccagcccgcccgaggucgagcgcgccgugcuggacgacggcaucuaccggaucaugcagcgcgggcugcucggccggucccaggugggggucggcguguuccaggagaacguguuccacaccauguggcacgucacccgcggggccgugcugauguaccagggcaagcggcuggagcccagcugggcguccgugaagaaggaccucaucagcuacggcgggggcuggcgccugcagggguccuggaacaccggcgaggagguccaggugaucgccguggagcccgggaagaaccccaagaacguccagacggcccccggcaccuucaagacccccgagggcgaggugggggccaucgcccuggacuucaagcccggcaccagcgggucccccaucgugaaccgggagggcaagaucgucggccucuacgggaacggcguggugacgaccagcgggaccuacgucagcgcgaucgcccaggccaaggccucccaggagggcccgcugcccgagaucgaggacgagguguuccgcaagcggaaccugaccaucauggaccuccaccccgggagcggcaagacgcgccgguaccugccggcgaucgugcgcgaggccaucaagcggaagcugcgcacccucauccuggcccccacccgcgucguggccuccgagauggccgaggcgcugaagggcaugcccauccgguaccagaccacggccgucaagagcgagcacaccgggaaggagaucgucgaccucaugugccacgccaccuucaccaugcgccugcugucccccgugcgggugccgaacuacaacaugaucaucauggacgaggcccacuucacggaccccagcuccaucgccgcgcgcggcuacaucagcacccgggucgggaugggcgaggccgccgccaucuucaugaccgccacgccgcccggguccguggaggcguucccgcagagcaacgccgugauccaggacgaggagcgcgacauccccgagcgguccuggaacagcggcuacgaguggaucacggacuuccccggcaagaccgucugguucgugcccuccaucaaggccgggaacgacaucgccaacugccuccgcaagaacggcaagcgggugauccagcugagccgcaagaccuucgacaccgaguaccagaagacgaagaacaacgacugggacuacgucgugaccaccgacaucuccgagaugggggcgaacuuccgggccgaccgcgugaucgacccgcggcgcugccugaagcccgucauccucaaggacggccccgagcgggugauccuggccgggcccaugccggucaccguggccagcgccgcgcagcgccggggccgcaucggccggaaccacaacaaggagggggaccaguacaucuacaugggccagccccugaacaacgacgaggaccacgcccacuggacggaggccaagaugcuccuggacaacaucaacacccccgaggggaucauccccgcccuguucgagccggagcgcgagaaguccgccgcgaucgacggcgaguaccgccuccgcggggaggcccgcaagaccuucguggagcugaugcggcgcggcgaccugcccgucuggcucagcuacaagguggccuccgagggcuuccaguacagcgaccggcgcuggugcuucgacggggagcggaacaaccaggugcuggaggagaacauggacgucgagaucuggaccaaggagggcgagcgcaagaagcugcggccccgcuggcucgacgcccggacguacagcgacccccuggcccugcgcgaguucaaggaguucgcggccgggcggcgcuccgugagcggcgaccucauccuggagaucggcaagcugccgcagcaccucacccagcgggcccagaacgcccuggacaaccuggugaugcuccacaacuccgagcagggcgggcgcgcguaccggcacgccauggaggagcugcccgacaccaucgagacccugaugcuccuggcccugaucgccguccucaccgggggcgugacccuguucuuccugagcgggaagggccucggcaagaccuccaucgggcugcugugcgugauggccagcuccguccuccuguggauggcgagcguggagccccacuggaucgccgccuccaucauccuggaguucuuccucauggugcugcugauccccgagccggaccgccagcggacgccccaggacaaccagcucgccuacgucgugaucggccugcuguucaugauccucaccguggccgcgaacgagauggggcugcuggagacgaccaagaaggaccucggcaucgggcacgucgccguggagaaccaccaccacgccgccaugcuggacguggaccugcaccccgccagcgcguggacccucuacgccgucgccaccacgaucaucaccccgaugaugcgccacaccaucgagaacaccacggccaacaucucccugaccgccaucgcgaaccaggccgccauccugaugggccucgacaagggcuggcccaucagcaagauggacaucggggugccccugcuggcccucggcugcuacucccaggugaacccccugacccugaccgcggccguccucaugcugguggcccacuacgccaucaucgggccgggccugcaggccaaggcgacgcgggaggcccagaagcgcaccgccgccgggaucaugaagaaccccaccguggacggcaucgucgccaucgaccucgaccccgugguguacgacgcgaaguucgagaagcagcugggccagaucaugcugcucauccugugcaccagccagauccugcucaugcgcacgaccugggcccugugcgaguccaucacccuggccaccgggccccucacgacccugugggagggcagcccggggaaguucuggaacaccaccaucgccgucuccauggccaacaucuuccggggcagcuaccuggcgggcgccgggcucgccuucucccugaugaagucccugggcgggggccgccgggggacgggcgcccagggcgagacccucggggagaaguggaagcgccagcugaaccagcugagcaaguccgaguucaacaccuacaagggcagcgggaucauggagguggaccgguccgaggcgaaggagggccucaagcgcggggagaccacgaagcacgccgugagccggggcaccgccaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagcccaucccgauggccacguacggguggaaccuggugaagcugcacagcggcaaggacgucuucuucaucccgcccgagaagugcgacacccuccugugcgacaucggggaguccagccccaacccgaccaucgaggagggccggacccugcgcgugcucaagaugguggagcccuggcugaagggcaaccaguucugcaucaagauccugaaccccuacaugcccuccgucguggagacgcucgagcagaugcagcggaagcacgggggcaugcuggugcgcaacccgcugagccggaacuccacccacgagauguacugggucagcugcgggaccggcaacaucguguccgcggugaacaugaccagccgcaugcuccugaaccgguucaccauggcccaccgcaagcccacguacgagcgggacgucgaccugggcgccgggacccgccacguggccguggagcccgaggucgccaaccucgacaucaucggccagcgcaucgagaacaucaagcacgagcacaaguccaccuggcacuacgacgaggacaaccccuacaagaccugggcguaccacgggagcuacgaggugaagccguccggcagcgccuccagcauggucaacgggguggugaagcugcugacgaagcccugggacgucauccccauggugacccagaucgccaugaccgacaccacgcccuucggccagcagcggguguucaaggagaaggucgacacccgcaccccgaaggccaagcggggcaccgcccagaucauggaggugacggcgcgcuggcucuggagcuuccugucccggaacaagaagccccgcaucugcacccgggaggaguucacccgcaaggugcggagcaacgccgccaucggggccgucuucguggacgagaaccaguggaacuccgcgaaggaggccguggaggacgagcgcuucugggaccugguccaccgggagcgcgagcuccacaagcagggcaagugcgcgaccugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgccgacgacacggccgggugggacacccgcaucaccgaggacgaccuccagaacgaggccaagaucaccgacaucauggagccggagcacgcgcugcuggccaaguccaucuucaagcucacguaccagaacaaggucgugcgggugcagcgccccgccaagaacggcaccgucauggacgugaucagccggcgcgaccagcgcggguccggccaggugggcaccuacgggcugaacaccuucacgaacauggaggcccagcugauccggcagauggagagcgagggcaucuucucccccagcgagcucgagacccccaaccuggccgagcgcguccuggacuggcucgagaaguacgggguggagcggcugaagcgcauggcgaucuccggcgacgacugcguggucaagccgaucgacgaccgguucgccaccgcccugaccgcccucaacgacauggggaaggugcgcaaggacaucccccagugggagcccagcaagggcuggaacgacuggcagcagguccccuucugcucccaccacuuccaccagcugaucaugaaggacggccgggagaucgucgugccgugccgcaaccaggacgagcugguggggcgggcccgcgucagccagggcgcgggguggagccuccgggagacggccugccugggcaaguccuacgcccagauguggcagcugauguacuuccaccgccgggaccuccgccuggccgcgaacgccaucugcagcgccgugcccguggacuggguccccaccucccggaccaccuggagcauccacgcccaccaccaguggaugacgaccgaggacaugcuguccguguggaaccgcguguggaucgaggagaaccccuggauggaggacaagacccacaucagcuccugggaggacgucccguaccucgggaagcgggaggaccaguggugcggcagccugaucggccugaccgcccgccccacgugggcgaccaacauccagguggccaucaaccaggugcggcgccucaucgggaacgagaacuaccuggacuacaugaccuccaugaagcgcuucaagaacgagagcgagcccgagggcgcccugugguga

SEQ ID NO: 7912 - RNA, 9879 nt, Artificial Sequence
  derived and/or modified CDS sequence (opt1) from DENV-1__HE795086__SS-prME
agcgugaccaugcugcucaugcugaugcccaccgcccuggccuuccaccucacgacccggggcggggagccccacaugaucgugagcaagcaggagcggggcaagagccugcuguucaagaccagcgccggggugaacaugugcacccucaucgccauggaccugggcgaguucugcgaggacaccaugaccuacaagugcccccgcaucaccgaggccgagcccgacgacguggacugcuggugcaacgccaccgacacgugggugaccuacgggaccugcagccagaccggcgagcaccggcgggacaagcgguccguggcccuggcgccccacgugggccucgggcuggagacgcgcaccgagaccuggaugagcuccgagggcgccuggaagcagauccagcggguggagaccugggcccugcgccaccccggguucacggugaucgcccucuuccuggcgcacgccaucggcaccagcaucacccagaaggggaucaucuucauccugcucaugcuggugacccccuccauggccaugcggugcgucggcaucggcagccgcgacuucguggaggggcuguccggcgccacguggguggacgucgugcucgagcacgggagcugcgugaccaccauggccaaggacaagcccacccuggacaucgagcugcucaagacggaggucaccaaccccgcggugcugcggaagcugugcaucgaggccaagaucuccaacaccaccacggacagccgcugcccgacccagggcgaggccacccucguggaggagcaggacgccaacuucgucugccggcgcaccuucguggaccggggcugggggaacggcugcgggcuguucggcaaggggucccugaucacgugcgccaaguucaagugcgugaccaagcucgagggcaagaucguccaguacgagaaccugaaguacagcgugaucgugaccguccacaccggcgaccagcaccagguggggaacgaguccacggagcacggcaccaccgcgaccaucacgccccaggcccccagcacggagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccagcggggccuccaccagccaggagaccuggaaccggaaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcucguccagaucaaguacgagggcaccgacgcccccugcaagauccccuucuccacccaggacgagaagggggugacccagaacggccggcugaucacggccaacccgaucgugaccgacaaggagaagcccgucaacaucgaggccgagccgcccuucggggagagcuacaucgugaucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccgucgggaagcuggugcaccagaucuucggcaccgccuacggggugcuguucagcggcgucuccuggaccaugaagaucgggaucggcgugcuccugaccuggcugggccucaacagccgcuccacgagccuguccaugaccugcaucgccguggggcuggucacccucuaccugggcgugauggugcaggccgacagcgggugcgucaucaacuggaagggccgggagcugaagugcgggagcggcaucuucgugaccaacgaggugcacacguggaccgagcaguacaaguuccaggcggacuccccgaagcgccucagcgccgccaucggcaaggccugggaggagggggucugcggcgugcgguccgccacccgccuggagaacaucauguggaagcagaucagcaacgagcugaaccacauccuccuggagaacgacaugaaguucaccguggucgugggggacguggcgggcauccuggcccaggggaagaagaugauccggccccagcccauggaguacaaguacuccuggaaguccuggggcaaggccaagaucaucggcgccgacguccagaacaccacguucaucaucgacgggcccaacaccccggagugccccgacgaccagcgcgcguggaacaucugggagguggaggacuacggcuucgggaucuucaccaccaacaucuggcucaagcugcgggacuccuacacccaggugugcgaccaccgccugaugagcgccgccaucaaggacuccaaggccguccacgccgacaugggcuacuggaucgagagcgagaagaacgagaccuggaagcucgcgcgggccuccuucaucgaggugaagaccugcaucuggcccaagagccacacccugugguccaacggcgugcuggagagcgagaugaucauccccaagaucuacgggggcccgaucucccagcacaacuaccgccccggguacuucacgcagaccgccggccccuggcaccucgggaagcuggagcuggacuucgaccucugcgagggcaccaccgucgugguggacgagcacugcggcaaccgggggccgagccugcgcacgaccaccgucaccggcaagaucauccacgaguggugcugccgguccugcacgcugccgccccugcgcuucaagggggaggacggcugcugguacgggauggagauccggcccgugaaggagaaggaggagaaccuggucaagagcauggucagcgccggcuccggcgagguggacagcuucucccuggggcuccugugcaucagcaucaugaucgaggaggugaugcgcucccgguggagccgcaagaugcugaugaccggcacccucgccgucuucuuccugcugaucauggggcagcucaccuggaacgaccugauccggcugugcaucauggugggcgcgaacgccuccgaccgcauggggaugggcacgaccuaccucgcccugauggccaccuucaagaugcgcccgauguucgccgugggccuccuguuccggcgccugaccagccgggagguccugcuccugacgaucgggcugucccucguggcgagcgucgagcugcccaacucccuggaggagcucggcgacgggcuggccaugggcaucaugauccugaagcuccugaccgacuuccagagccaccagcugugggccacccuccugucccugaccuucaucaagacgaccuucagccuccacuacgccuggaagaccauggcgauggugcuguccaucgugagccuguucccccucugccuguccaccacgagccagaagaccaccuggcugcccguccuccugggcucccuggggugcaagccgcucaccauguuccugaucgccgagaacaagaucuggggccgcaagagcuggccccugaacgaggggaucauggccgugggcaucgugagcauccuccuguccagccugcucaagaacgacgucccccuggccgggccccugaucgccggcggcaugcucaucgcgugcuacgugaucuccgggagcuccgccgaccugagccuggagaaggccgccgagguguccugggaggaggaggccgagcacagcggcgcgucccacaacauccucgucgaggugcaggacgacgggacgaugaagaucaaggacgaggagcgggacgacacccugaccauccugcucaaggccacccugcuggccgugagcggcgucuacccgcucuccauccccgccacccuguucgugugguacuucuggcagaagaagaagcagcgcagcggggugcugugggacacgcccagcccgcccgaggucgagcgggccgugcucgacgacggcaucuaccgcaucaugcagcggggccugcuggggcgcagccaggugggcgucgggguguuccaggagaacguguuccacaccauguggcacgucacccggggcgcggugcugauguaccaggggaagcgccucgagcccuccugggccagcgugaagaaggaccugaucuccuacggcggcggguggcggcugcagggcagcuggaacaccggggaggagguccaggugaucgccguggagcccggcaagaaccccaagaacguccagacggcccccgggaccuucaagaccuccgagggcgaggugggcgccaucgcgcucgacuucaagcccgggaccagcggcagccccaucgugaaccgcgaggggaagaucgucggccuguacggcaacgggguggugacgaccuccggcaccuacgucagcgccaucgcccaggccaaggcgucccaggacgggccccugccggagaucgaggacgagguguuccggaagcgcaaccucaccaucauggaccugcaccccggcagcgggaagacgcggcgcuaccugcccgccaucgugcgggaggccaucaagcgcaagcuccggacccugauccuggccccgacccgcgucguggccuccgagauggcggaggcccucaagggcaugcccauccgcuaccagaccacggccgucaagagcgagcacaccggcaaggagaucgucgaccugaugugccacgccaccuucaccaugcggcugcucucccccgugcgcgugcccaacuacaacaugaucaucauggacgaggcccacuucacggacccgagcuccaucgcggcccggggguacaucagcacccgcgucggcaugggggaggccgccgccaucuucaugaccgcgacgccgcccggcuccguggaggccuucccccagagcaacgccgugauccaggacgaggagcgggacaucccggagcgcuccuggaacagcggguacgaguggaucacggacuuccccggcaagaccgucugguucgugcccuccaucaagagcggcaacgacaucgccaacugccugcggaagaacgggaagcgcgugauccagcugucccggaagaccuucgacaccgaguaccagaagacgaagaacaacgacugggacuacgucgugaccaccgacaucagcgagaugggcgcgaacuuccgcgccgaccgggugaucgacccccgccggugccucaagccggucauccugaaggacgggcccgagcgcgugauccuggccggccccaugcccgucaccguggccuccgccgcgcagcggcgcgggcggaucggccgcaaccacaacaaggagggcgaccaguacaucuacauggggcagccgcucaacaacgacgaggaccacgcccacuggacggaggccaagaugcugcuggacaacaucaacacccccgagggcaucauccccgcccucuucgagcccgagcgggagaaguccgccgcgaucgacggggaguaccgccugcgcggcgaggcccggaagaccuucguggagcugaugcgccgcggggaccucccggucuggcugagcuacaagguggccuccgagggcuuccaguacagcgaccgccgguggugcuucgacggcgagcgcaacaaccaggugcuggaggagaacauggacgucgagaucuggaccaaggagggggagcggaagaagcuccgcccccgguggcuggacgcccgcacguacuccgacccccuggcccuccgggaguucaaggaguucgcggccggccgccggagcguguccggggaccugauccuggagaucggcaagcucccccagcaccugacccagcgcgcccagaacgcccuggacaaccucgugaugcugcacaacagcgagcagggcgggcgggcguaccgccacgccauggaggagcugccggacaccaucgagacccucaugcugcuggcccucaucgccguccugacgggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagcccgaccgccagcggaccccgcaggacaaccagcuggccuacgucgugaucgggcuccucuucaugauccugaccguggccgcgaacgagaugggccugcucgagacgaccaagaaggaccuggggaucggccacgucgccguggagaaccaccaccacgccgccaugcuggacguggaccuccaccccgccuccgcguggacccuguacgccgucgccaccacgaucaucacccccaugaugcgccacaccaucgagaacaccacggccaacaucagccugaccgccaucgcgaaccaggccgccauccucauggggcuggacaagggcuggccgaucuccaagauggacaucggcgugccccugcucgcccuggggugcuacagccaggugaacccccugacccucaccgcggccguccugaugcugguggcccacuacgccaucaucggccccgggcuccaggccaaggcgacgcgggaggcccagaagcgcaccgccgccggcaucaugaagaacccgaccguggacgggaucgucgccaucgaccuggaccccgugguguacgacgcgaaguucgagaagcagcugggccagaucaugcuccugauccugugcaccucccagauccuccugaugcgcacgaccugggcccugugcgagagcaucacccucgccaccggcccccugacgacccugugggaggggucccccggcaaguucuggaacaccaccaucgccgucagcauggccaacaucuuccgggggagcuaccucgcgggcgccggccuggccuucucccugaugaagucccucgggggcgggcgccggggcacgggggcccagggcgagacccugggcgagaaguggaagcgccagcugaaccagcucuccaagagcgaguucaacaccuacaagcgguccgggaucauggagguggaccgcagcgaggcgaaggagggccugaagcgcggggagaccacgaagcacgccgugucccgcggcaccgccaagcugcggugguucgucgagcgcaaccucgugaagccggaggggaaggugaucgaccugggcugcggccgcggcggguggagcuacuacugcgccgggcugaagaaggucaccgaggugaagggguacaccaagggcgggcccggccacgaggagcccauccccauggccacguacggguggaaccuggugaagcuccacuccggcaaggacgucuucuucaucccgcccgagaagugcgacacccugcugugcgacaucggggagagcucccccaaccccaccaucgaggagggccgcacccuccgggugcugaagaugguggagccguggcugcgcgggaaccaguucugcaucaagauccucaaccccuacaugcccagcgucguggagacgcuggagcagaugcagcggaagcacggcggcaugcuggugcgcaacccccucucccggaacagcacccacgagauguacugggucuccugcgggaccggcaacaucgugagcgcggugaacaugaccucccgcaugcugcugaaccgguucaccauggcccaccgcaagccgacguacgagcgcgacgucgaccucggggccggcacccggcacguggccguggagcccgaggucgccaaccuggacaucaucggccagcgcaucgagaacaucaaguacgagcacaagagcaccuggcacuacgacgaggacaaccccuacaagaccugggcguaccacggguccuacgaggugaagcccagcggcagcgccuccagcauggucaacgggguggugaagcugcucacgaagccgugggacgucauccccauggugacccagaucgccaugaccgacaccacgcccuucggccagcagcggguguucaaggagaaggucgacacccgcacccccaaggccaagcgggggaccgcccagaucauggaggugacggcgaaguggcuguggggcuuccugucccgcaacaagaagccgcggaucugcacccgcgaggaguucacccggaaggugcgcagcaacgccgccaucggcgccgucuucguggacgagaaccaguggaacuccgcgaaggaggccguggaggacgagcgguucugggaccucguccaccgcgagcgggagcugcacaagcaggggaagugcgcgaccugcguguacaacaugaugggcaagcgcgagaagaagcugggggaguucggcaaggccaaggggagccgggccaucugguacauguggcucggcgcgcgcuuccuggaguucgaggcccugggcuucaugaacgaggaccacugguucucccgggagaacagccucuccgggguggagggcgaggggcugcacaagcugggcuacauccuccgcgacaucagcaagauccccgggggcaacauguacgccgacgacacggccggcugggacacccggaucaccgaggacgaccugcagaacgaggccaagaucaccgacaucauggagcccgagcacgcgcugcucgccaaguccaucuucaagcugacguaccagaacaaggucgugcgcgugcagcggccggccaagaacgggaccgucauggacgugaucagccgccgcgaccagcggggcuccggccaggugggcaccuacggccugaacaccuucacgaacauggaggcccagcucauccgccagauggagagcgaggggaucuucucccccagcgagcuggagacccccaaccuggccggccggguccucgacuggcuggagaagcacgggguggagcgccugaagcggauggcgaucuccggcgacgacugcguggucaagcccaucgacgaccgcuucgccaccgcccucaccgcccugaacgacauggggaaggugcggaaggacaucccgcagugggagcccagcaagggcuggaacgacuggcagcagguccccuucugcagccaccacuuccaccagcugaucaugaaggacggccgcgagaucgucgugcccugccggaaccaggacgagcucguggggcgcgcccgggucucccagggcgcgggguggagccugcgcgagacggccugccugggcaaguccuacgcccagauguggcagcucauguacuuccaccggcgcgaccugcggcuggccgcgaacgccaucugcagcgccgugccgguggacuggguccccaccucccgcaccaccuggagcauccacgcccaccaccaguggaugacgaccgaggacaugcucuccguguggaaccggguguggaucgaggagaaccccuggauggaggacaagacccacaucagcuccugggaggacguccccuaccuggggaagcgcgaggaccaguggugcggcagccugaucggccucaccgcccgggcgacgugggccaccaacauccagguggccaucaaccaggugcgccgccugaucgggaacgagaacuaccuggacuacaugaccuccaugaagcgguucaagaacgagagcgacccggagggcgcccucugguga

SEQ ID NO: 7913 - RNA, 9879 nt, Artificial Sequence
  derived and/or modified CDS sequence (opt1) from DENV-1__AB189120__SS-prME
agcgugaccaugcugcucaugcugcugcccaccgugcucaccuuccaccugaccacccgcggcggggagccccacaugaucgugagcaagcaggagcggggcaagagccuccuguucaagaccuccgccggggugaacaugugcacccugaucgccauggaccugggcgagcucugcgacgacaccaugaccuacaagugcccccgcaucaccgagaccgagcccgacgacguggacugcuggugcaacgcgaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggcggcagauccagaagguggagaccugggcccugcgccaccccggguucaccgugaucgcgcuguuccucgcccacgccaucggcaccagcaucacgcagaaggggaucaucuucauccugcugaugcucgucacccccuccauggccaugcggugcgugggcaucggcaaccgcgacuucguggaggggcugagcggcgcgaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugcccgacccagggcgaggccacgcuggucgaggagcaggacgcgaacuucgugugccggcgcaccuucguggaccggggcugggggaacggcugcggccucuucggcaaggggagccugaucacgugcgccaaguucaagugcgucaccaagcuggagggcaagaucgugcaguacgagaaccucaaguacuccgugaucgucacggugcacaccggcgaccagcaccaggucgggaacgagaccaccgagcacggcaccaucgccacgaucacgccccaggcccccaccagcgagauccagcugaccgacuacggggcccugacgcucgacugcagcccccggaccggccuggacuucaacgagauggugcugcucaccaugaaggagaaguccuggcuggugcacaagcagugguuccuggaccucccgcugcccuggaccuccggggcgagcacgagccaggagaccuggaaccggcaggaccugcucgucaccuucaagaccgcccacgccaagaagcaggaggccguggugcugggcucccaggagggcgccaugcacacggcgcugaccggggccaccgagauccagaccagcggcacgaccaccaucuucgccgggcaccucaagugccgccugaagauggacaagcugacccucaagggcaucuccuacgucaugugcacggggagcuucaagcuggagaaggagguggccgagacccagcacggcaccgugcugguccaggugaaguacgagggcaccgacgcccccugcaagauccccuucuccagccaggacgagaagggggugacgcagaacggccggcuggucaccgcgaacccgaucgugaccgacaaggagaagcccgugaacaucgaggccgagccgcccuucggggaguccuacaucgucgugggcgccggcgagaaggcccucaagcugagcugguucaagaagggguccagcaucggcaagauguucgaggcgaccgcccgcggggcccggcgcauggccauccugggcgacacggccugggacuucggguccaucggcggcguguucaccagcgucgggaagcucgugcaccagaucuucggcaccgcguacggggugcuguucuccggcgucagcuggaccaugaagaucgggaucggcauccugcucacguggcugggccugaacucccgcagcaccucccucagcaugaccugcaucgccguggggauggugacccuguaccugggcgucauggugcaggccgacuccgggugcgugaucaacuggaagggccgggagcucaagugcgggagcggcaucuucgucacgaacgaggugcacaccuggaccgagcaguacaaguuccaggccgacagcccgaagcgccuguccgccgcgaucggcaaggccugggaggagggggugugcggcauccggagcgccacccgccuggagaacaucauguggaagcagaucuccaacgagcucaaccacauccugcuggagaacgacaugaaguucaccgucguggugggggacgucagcggcauccucgcccaggggaagaagacgauccggccccagcccauggagcacaaguacuccuggaaguccuggggcaaggccaagaucaucggcgcggacgugcagaacaccaccuucaucaucgacgggcccaacaccccggagugccccgacgaccagcgcgccuggaacaucugggagguggaggacuacggcuucgggaucuucacgaccaacaucuggcugaagcugcgggacuccuacacccaggucugcgaccaccgccucaugagcgccgccaucaaggacuccaaggcggugcacgccgacaugggcuacuggaucgagagcgagaagaacgagaccuggaagcuggcccgggccuccuucaucgaggugaagacgugcgucuggcccaagagccacacccugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcacgaccguggucguggacgagcacugcggcaaccgggggccgagccugcgcaccaccacggugaccggcaagaucauccacgaguggugcugccgguccugcacccugccgccccugcgcuucaagggggaggacggcugcugguacgggauggagauccggcccgucaaggagaaggaggagaaccuggucaagagcauggugagcgcgggcuccggcgaggucgacagcuucucccucgggcugcugugcaucagcaucaugaucgaggaggugaugcgcucccgguggagccgcaagaugcucaugaccggcacgcugguggucuuccugcuccugacccuggggcagcucaccuggaacgaccugauccggcugugcaucauggugggcgccaacgccuccgacaacauggggaugggcaccacguaccucgcccugauggccaccuuccgcaugcgcccgauguucgccgucgggcuccucuuccggcgccugaccagccgggaggugcugcuccugaccguggggcugucccucgucgccagcguggagcugcccaacucccuggaggagcucggcgacgggcuggccaugggcaucaugauccugaagcuccugacggacuuccagagccaccagcugugggccacccuccugucccugaccuucgugaagaccacgcucagccugcacuacgccuggaagaccauggcgaugauccuguccaucgucagccuccugccccugugccucuccaccaccagccagaagacgaccuggcugcccgugcugcucggcucccuggggugcaagccgcugaccauguuccucaucaccgagaacaagaucuggggccgcaagagcuggccccugaacgaggggaucauggccgugggcaucgucagcauccugcucuccagccugcugaagaacgacgugccccucgccgggccccugaucgccggcggcaugcugaucgcgugcuacgugaucuccgggagcuccgccgaccucagccuggagaaggccgccaaggucuccugggaggaggaggccgagcacagcggcgcgucccacaacauccugguggagauccaggacgacgggaccaugaagaucaaggacgaggagcgggacgacacgaucaccauccuccugaaggccacccugcucgccaucagcggcguguacccgauguccauccccgccacccuguucgucugguacuucuggcagaagaagaagcagcgcagcggggugcugugggacacgcccagcccgcccgagguggagaaggccguccuggacgacggcaucuaccggauccuccagcgcggccugcuggggcggagccaggugggcgugggggucuuccaggagggcguguuccacaccauguggcacgugacccgcggggcgguccucauguaccagggcaagcggcuggagcccuccugggccagcgugaagaaggaccugaucuccuacggcgggggcuggcgcuuccaggggagcuggaacaccggcgaggaggugcaggucaucgccguggagcccgggaagaaccccaagaacgugcagacggcccccggcaccuucaagaccuccgagggcgaggucggggccaucgcgcucgacuucaagcccggcaccagcgggagccccaucgugaaccgggagggcaagaucgugggccuguacgggaacggcgucgugacgaccuccgggaccuacgugagcgccaucgcccaggccaaggccucccaggagggcccccugccggagaucgaggacgaggucuuccgcaagcggaaccucaccaucauggaccugcaccccgggagcggcaagacgcgccgguaccugcccgcgaucgugcgcgaggccaucaagcggaagcuccgcacccuggugcuggccccgacccgggucguggccuccgagauggcggaggcccucaagggcaugcccauccgcuaccagaccacggccgucaagagcgagcacaccgggaaggagaucgucgaccugaugugccacgccaccuucaccaugcgccugcucucccccgugcgggugcccaacuacaacaugaucaucauggacgaggcccacuucacggacccggcgagcaucgccgcccgcggcuacaucuccacccgggucgggaugggcgaggccgccgcgaucuucaugaccgccacgccgcccgggagcguggaggccuucccccaguccaacgccgugauccaggacgaggagaaggacaucccggagcgcagcuggaacuccggcuacgacuggaucacggacuuccccggcaagaccgucugguucgugcccagcaucaaguccgggaacgacaucgccaacugccugcggaagaacggcaagcgcgugauccagcugagccggaagaccuucgacaccgaguaccagaagacgaagaacaacgacugggacuacgucgugaccaccgacaucuccgagaugggggcgaacuuccgcgccgaccgggucaucgacccccgccggugccucaagccggugauccugaaggacggccccgagcgcgugauccuggccgggcccaugcccgucaccguggccagcgcggcccagcggcgcggccggaucggccgcaaccagaacaaggagggggaccaguacaucuacaugggccagccgcucaacaacgacgaggaccacgcccacuggacggaggccaagaugcugcuggacaacaucaacacccccgaggggaucauccccgcccucuucgagcccgagcgggagaaguccgcggccaucgacggcgaguaccgccugcgcggggaggcccgcaagaccuucguggagcugaugcgccggggcgaccucccggucuggcugagcuacaagguggccagcgagggcuuccaguacuccgaccgccgguggugcuucgacggggagcgcaacaaccaggugcuggaggagaacauggacgucgagaucuggaccaaggagggcgagcggaagaagcuccgcccccgguggcuggacgcccgcacguacagcgacccccuggcgcuccgggaguucaaggaguucgccgccgggcgccgguccgugagcggcgaccugauccuggagaucggcaagcucccccagcaccugacccagcgcgcccagaacgcccuggacaaccucgugaugcugcacaacuccgagcagggcgggaaggcguaccggcacgccauggaggagcugccggacaccaucgagaccaucaugcuccuggcccugaucgccguccucaccgggggcgugacgcuguucuuccugagcgggcgcggccucggcaagaccuccaucgggcugcugugcgugaugagcuccagcgcgcuccuguggauggccuccgucgagccccacuggaucgccgccagcaucauccuggaguucuuccucauggugcugcugauccccgagcccgaccggcagcgcaccccgcaggacaaccagcucgccuacguggucaucggccugcuguucaugauccucaccguggcggccaacgagauggggcugcuggagacgaccaagaaggaccucggcaucgggcacgccgccgccgagaaccaccaccacgcggccaugcuggacguggaccugcaccccgccuccgccuggacccucuacgccgucgcgaccacgaucaucacccccaugaugcggcacaccaucgagaacaccacggccaacaucagccugaccgccaucgccaaccaggccgcgauccugaugggccucgacaagggcuggccgaucuccaagauggacaucggggugccccugcuggcccucggcugcuacagccaggugaacccccugacccugaccgccgccguccucaugcugguggcgcacuacgccaucaucgggcccggccugcaggccaaggccacgcgcgaggcccagaagcggaccgcggccgggaucaugaagaacccgaccguggacggcaucgucgccaucgaccucgaccccgugguguacgacgccaaguucgagaagcagcugggccagaucaugcugcucauccugugcaccucccagauccugcucaugcgcacgaccugggcccugugcgagagcaucacccuggcgaccgggccccucacgacccugugggagggcucccccgggaaguucuggaacaccaccaucgccgucagcauggccaacaucuuccggggcagcuaccuggccggcgccgggcucgcguucucccugaugaagucccugggcgggggccgccgcgggacgggcgcccagggcgagacccucggggagaaguggaagcggcagcugaaccagcuguccaagagcgaguucaacaccuacaagcgcuccggcaucaucgagguggaccggagcgaggccaaggaggggcucaagcgcggcgagaccacgaagcacgccgugucccgggggaccgcgaagcugcgcugguucgucgagcggaaccuggugaagccggagggcaaggugaucgaccugggcugcgggcgcggcggguggagcuacuacugcgccggccucaagaaggucaccgaggugaagggguacaccaagggcggccccgggcacgaggagcccauccccauggccacguacggcuggaaccuggugaagcugcacuccgggaaggacgucuucuucaucccgcccgagaagugcgacacccuccugugcgacaucggcgagagcucccccaaccccaccaucgaggaggggcggacccugcgcgugcucaagaugguggagccguggcugcggggcaaccaguucugcaucaagauccugaaccccuacaugcccagcgucguggagacccucgagcagaugcagcgcaagcacggcgggaugcuggugcggaacccccugucccgcaacagcacgcacgagauguacugggucuccugcggcaccgggaacaucgugagcgccgugaacaugaccucccggaugcuccugaaccgcuucaccauggcccaccggaagccgacguacgagcgcgacgucgaccugggcgcgggcacccggcacguggccguggagcccgaggucgccaaccucgacaucaucgggcagcgcaucgagaacaucaagaacgagcacaagagcaccuggcacuacgacgaggacaaccccuacaagaccugggccuaccacggcuccuacgaggugaagcccagcgggagcgccuccagcauggucaacggcguggugcgccugcugacgaagccgugggacgucauccccauggugacccagaucgcgaugaccgacaccacgcccuucgggcagcagcggguguucaaggagaaggucgacacccgcacccccaaggccaagcggggcaccgcccagaucauggaggugacggccaaguggcucuggggcuuccugucccgcaacaagaagccgcggaucugcacccgcgaggaguucacccggaaggugcgcagcaacgccgcgaucggggccgucuucguggacgagaaccaguggaacuccgccaaggaggccguggaggacgagcgguucugggaccugguccgccgggagcgcgagcuccacaagcagggcaagugcgcgaccugcguguacaacaugauggggaagcgggagaagaagcugggcgaguucgggaaggccaagggcagccgcgccaucugguacauguggcugggcgcccgguuccucgaguucgaggcccugggguucaugaacgaggaccacugguucucccgcgagaacagccuguccggcguggagggggagggccuccacaagcugggguacauccugcgggacaucagcaagauccccggcggcaacauguacgcggacgacacggccgggugggacacccgcaucaccgaggacgaccuccagaacgaggccaagaucaccgacaucauggagcccgagcacgcccugcuggccacguccaucuucaagcucaccuaccagaacaaggucgugcgggugcagcgcccggcgaagaacggcaccgucauggacgugaucagccggcgcgaccagcgcggguccggccaggugggcaccuacgggcugaacacguucaccaacauggaggcccagcugauccggcagauggagagcgagggcaucuucucccccagcgagcucgagacccccaaccuggccgggcgcguccuggacuggcucgagaagcacggcaccgagcggcugcgccggauggccaucuccggggacgacugcguggugaagcccaucgacgaccgcuucgccacggcgcugaccgcccucaacgacaugggcaagauccggaaggacaucccgcagugggagcccagcaagggcuggaacgacuggcagcagguccccuucugcagccaccacuuccaccagcugaucaugaaggacgggcgcgagaucguggugcccugccggaaccaggacgagcuggucggccgcgcccgggugucccagggggccggcuggagccuccgcgagaccgccugccuggggaaguccuacgcgcagauguggcagcugauguacuuccaccggcgcgaccuccggcuggccgccaacgccaucugcagcgcggugccggucgacugggugcccaccucccgcacgaccuggagcauccacgcccaccaccaguggaugaccaccgaggacaugcuguccguguggaaccgggucuggaucgaggagaaccccuggauggaggacaagacccacgugagcuccugggaggacgugcccuaccucggcaagcgcgaggaccaguggugcggcagccugaucgggcugacggcccgggccaccugggccaccaacauccaggucgcgaucaaccaggugcgccgccucaucggcaacgagaacuaccuggacuacaugaccuccaugaagcgguucaagaacgagagcgacccggagggggcccugugguga

SEQ ID NO: 7914 - RNA, 9879 nt, Artificial Sequence
  derived and/or modified CDS sequence (opt1) from DENV-1__AB189121__SS-prME
agcgugaccaugcuguucaugcuccugcccaccgcccuggccuuccaccucaccacccgcggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccucgcgccccacgugggccuggggcuggagacccgcaccgagaccuggaugagcuccgagggcgccuggcggcagauccagaagguggagaccugggcccuccgccaccccggguucaccgugauggcccuguuccuggcccacgcgaucggcaccagcaucacccagaaggggaucaucuucauccuccugaugcuggugacgcccuccauggccaugcggugcgugggcaucggcaaccgcgacuucguggaggggcucagcggcgccaccuggguggacguggugcuggagcacggguccugcgugaccaccauggccaaggacaagcccacgcuggacaucgagcuccugaagaccgaggucaccaaccccgccgugcugcggaagcucugcaucgaggcgaagaucagcaacaccacgaccgacucccgcugcccgacccagggcgaggccacccugguggaggagcaggacacgaacuucgucugccggcgcaccuucguggaccggggcugggggaacggcugcgggcuguucggcaaggggagccucaucacgugcgccaaguucaagugcgugaccaagcuggagggcaagaucguccaguacgagaaccugaaguacuccgugaucgugacgguccacaccggcgaccagcaccagguggggaacgagaccaccgagcacggcaccacggccaucaucacgccccaggcccccaccagcgagauccagcucaccgacuacggggcgcugacgcuggacugcagcccccgcaccggccucgacuucaacgagaugguccugcugaccaugaaggagaaguccuggcucgugcacaagcagugguuccuggaccugccgcuccccuggaccuccggggccagcacgagccaggagaccuggaaccggcaggaccugcuggugaccuucaagaccgcccacgccaagaagcaggaggucguggugcucggcucccaggagggcgccaugcacacggcgcugaccggggccaccgagauccagaccagcggcacgaccaccaucuucgccgggcaccugaagugccgccucaagauggacaagcugacccugaagggcgucuccuacgugaugugcacggggagcuucaagcucgagaaggagguggccgagacccagcacggcaccguccugguccaggugaaguacgagggcaccgacgcccccugcaagauccccuucuccagccaggacgagaagggggucauccagaacggccggcugaucacggcgaacccgaucgugaccgacaaggagaagcccgugaacaucgaggccgagccgcccuucggggaguccuacaucgucgugggcgccggcgagaaggcccugaagcucagcugguucaagaagggguccagcaucggcaagauguucgaggcgaccgcccgcggggcccggcgcauggccauccugggcgacaccgccugggacuucggguccaucggcggcguguucacgagcgucgggaagcuggugcaccagaucuucggcaccgcguacgggguccucuucuccggcgucagcuggaccaugaagaucgggaucggcauccugcugaccuggcucggccugaacucccgcagcacgucccugagcaugaccugcaucgccguggggauggugacccucuaccugggcgucauggugcaggccgacuccgggugcgugaucaacuggaagggccgggagcugaagugcgggagcggcaucuucgucaccaacgaggugcacacguggaccgagcaguacaaguuccaggccgacagcccgaagcgccucuccgccgcgaucggcaaggccugggaggagggggugugcggcauccggagcgccacccgccuggagaacaucauguggaagcagaucuccaacgagcugaaccacauccuccuggagaacgacaugaaguucaccgucguggugggggacgucagcggcauccuggcccaggggaagaagaugauccggccccagcccauggagcacaaguacuccuggaaguccuggggcaaggccaagaucaucggcgcggacgugcagaacaucaccuucaucaucgacgggcccaacacguccgagugcccggacaaccagcgcgccuggaacaucugggagguggaggacuacggcuucgggaucuucaccaccaacaucuggcucaagcugcgggacagcuacacccaggucugcgaccaccgccugauguccgccgccaucaaggacagcaaggcggugcacgccgacaugggcuacuggaucgaguccgagaagaacgagacguggaagcucgcccgggccagcuucaucgaggugaagaccugcaucuggcccaagucccacacccuguggagcaacggcguccuggaguccgagaugaucauccccaagaucuacgggggccccgugagccagcacaacuaccgcccgggguacuucacccagacggccggccccuggcaccucgggaagcuggagcuggacuucgaccucugcgagggcaccaccguggucguggacgagaacugcggcaaccgggggcccucccugcgcaccacgaccgugaccggcaagaccauccacgaguggugcugccggagcugcacgcugccgccccuccgcuucaagggggaggacggcugcugguacgggauggagauccggcccgucaaggagaaggaggagaaccuggucaagagcaugguguccgcgggcagcggcgaggucgacuccuucagccuggggcuccugugcaucuccaucaugaucgaggaggugaugcgcagccgguggucccgcaagaugcugaugaccggcacccucgccguguuccugcugcucaccauggggcagcugacguggaacgaccugauccggcucugcaucauggucggcgccaacgccagcgacaugauggggaugggcaccaccuaccuggcccugauggcgaccuuccgcaugcgccccauguucgccgugggccuccuguuccggcgccugacgucccgggagguccuccugcugaccguggggcucagccugguggccuccgucgagcugccgaacagccucgaggagcugggcgacgggcuggccaugggcaucaugaugcucaagcugcugaccgacuuccagccccaccagcucugggccacccugcugucccucacguucgugaagaccaccuucagccugcacuacgcguggaagaccauggccaugauccuguccaucgugagccuccugccccugugccucuccacgaccagccagaagaccaccuggcugcccguccugcucggcucccuggggugcaagccgcugacgaugcuccugaucaccgagaacaagaucuggggccgccggagcuggccccugaacgaggggaucauggccaucggcaucgugagcauccuccuguccagccugcucaagaacgacgugccccuggccgggccccugaucgcgggcggcaugcucaucgccugcuacgucaucuccgggagcuccgccgaccugagccuggagaaggccgccgagguguccugggaggacgaggcggagcacagcggcgccucccacaacauccucguggagguccaggacgacgggaccaugaagaucaaggacgaggagcgcgacgacacccugaccauccugcucaaggccacgcugcuggccaucagcggcguguacccgauguccauccccgccacccucuucgugugguacuucuggcagaagaagaagcagcggagcgggguccugugggacacccccagcccgcccgagguggagcgcgcggugcuggacaacggcaucuaccggauccugcagcgcggccuccuggggcggagccaggucggcguggggguguuccaggagggcgucuuccacaccauguggcacgugacgcgcggggccgugcugauguaccagggcaagcggcucgagcccuccugggccagcgucaagcgcgaccugaucuccuacggcgggggcuggcgguuccaggggagcuggaacaccggcgaggagguccaggugaucgccgucgagcccgggaagaaccccaagaacgugcagaccacccccggcacguucaagacccccgagggcgaggugggggccaucgcgcuggacuucaagcccggcaccuccgggagccccaucgucaaccgcgagggcaagaucgugggccucuacgggaacggcguggucaccacgagcgggaccuacguguccgccaucgcccaggccaaggccagccaggagggcccgcugcccgagaucgaggacgagguguuccggaagcgcaaccugaccaucauggaccuccaccccggguccggcaagacccggcgcuaccugccggcgaucguccgggaggccaucaagcgcaagcugcgcacgcucgugcuggcccccacccggguggucgccagcgagauggcggaggcccugaagggcaugcccauccgcuaccagaccaccgccgugaaguccgagcacacggggaaggagaucguggaccucaugugccacgccaccuucaccaugcggcugcugagccccguccgcgugccgaacuacaacaugaucaucauggacgaggcccacuucaccgaccccgcguccaucgccgcccggggcuacaucagcacgcgcguggggaugggcgaggccgccgcgaucuucaugaccgccacgccgcccggguccgucgaggccuucccgcagagcaacgccgugauccaggacgaggagcgggacauccccgagcgcuccuggaacagcggcuacgaguggaucaccgacuuccccggcaagacggugugguucguccccuccaucaagagcgggaacgacaucgccaacugccuccggaagaacggcaagcgcguggugcagcugucccggaagaccuucgacaccgaguaccagaagaccaagaacaacgacugggacuacgucgugacgaccgacaucagcgagaugggggcgaacuuccgcgccgaccgggucaucgacccgcgccggugccugaagcccgugauccucaaggacggccccgagcgcgugauccuggccgggcccaugccggucaccguggccuccgcggcccagcggcgcggccggaucggccgcaaccccaacaaggagggggaccaguacguguacaugggccagccccugaacaacgacgaggaccacgcccacuggaccgaggccaagaugcuccuggacaacaucaacacgcccgaggggaucaucccggcccuguucgagcccgagcgcgagaaguccgcggccaucgacggcgaguaccggcuccgcggggaggcccggaagaccuucgucgagcugaugcgccggggcgaccugcccguguggcucuccuacaagguggccagcgagggcuuccaguacagcgaccgccgguggugcuucgacggggagcgcaacaaccagguccuggaggagaacauggacguggagaucuggaccaaggagggcgagcggaagaagcugcgcccccgguggcucgacgcccgcaccuacuccgacccgcuggcgcugcgggaguucaaggaguucgccgccgggcgccggagcguguccggcgaccucauccuggagaucggcaagcugccccagcaccucacgcagaaggcccagaacgcccuggacaaccuggucaugcuccacaacagcgagcagggcgggaaggcguaccgccacgccauggaggagcugcccgacaccaucgagacccugaugcuccuggcccugaucgccgugcucaccgggggcgugacccuguucuuccuguccgggcggggccucggcaagacgagcaucgggcugcugugcgucauggcguccagcgcccuccuguggauggccuccguggagccccacuggaucgccgccagcaucauccuggaguucuuccucauggugcugcugaucccggagcccgaccgccagcggacgccccaggacaaccagcucgcguacgucgugaucggccugcuguucaugauccucaccguggccgccaacgagauggggcugcuggagaccacgaagaaggaccucggcaucgggcacgccgccgcggagaaccaccaccacgccgccaugcuggacgucgaccugcacccggccuccgccuggacccucuacgcgguggccaccaccaucaucacgcccaugaugcgccacaccaucgagaacaccaccgccaacaucagccugacggccaucgccaaccaggcggccauccugaugggccucgacaagggcuggcccaucuccaagauggacaucggggugccccugcuggcccucggcugcuacagccaggucaacccgcugacccugaccgccgcggugcucaugcugguggcccacuacgccaucaucgggcccggccugcaggccaaggccacccgggaggcgcagaagcgcacggccgccgggaucaugaagaaccccaccgucgacggcaucguggccaucgaccucgaccccguggucuacgacgccaaguucgagaagcagcugggccagaucaugcugcucauccugugcaccucccagauccugcucaugcgcaccacgugggcgcugugcgagagcaucacccuggccaccgggccgcucaccacgcugugggagggcucccccgggaaguucuggaacaccaccaucgccgugagcauggccaacaucuuccggggcuccuaccuggccggcgcggggcucgccuucagccugaugaagucccugggcgggggccgccgggggaccggcgcccagggcgagacgcucggggagaaguggaagcgccagcugaaccagcuguccaagagcgaguucaacaucuacaagcgguccggcaucaucgagguggaccgcagcgaggccaaggaggggcucaagcggggcgagaccaccaagcacgcggucucccgcgggaccgccaagcugcggugguucguggagcgcaaccuggugaagcccgagggcaaggucaucgaccugggcugcgggcggggcggguggagcuacuacugcgccggccucaagaaggugacggaggugaagggguacaccaagggcggccccgggcacgaggagccgauccccauggccaccuacggcuggaaccuggucaagcugcacuccgggaaggacguguucuucacgccgcccgagaagugcgacacgcuccugugcgacaucggcgagagcuccccgaaccccaccaucgaggaggggcgcacccugcgggugcucaagauggucgagcccuggcugcgcggcaaccaguucugcaucaagauccugaaccccuacaugccgagcgugguggagacccucgagaagaugcagcggaagcacggcgggaugcugguccgcaacccccugucccggaacagcacccacgagauguacuggguguccugcggcacggggaacaucgugagcgccgucaacaugaccucccgcaugcuccugaaccgguucaccauggcgcaccgcaagcccaccuacgagcgcgacguggaccugggcgccggcacgcggcacguggccgucgagcccgagguggccaaccucgacaucaucgggcagcgcaucgagaacaucaagaacgagcacaagagcaccuggcacuacgacgaggacaacccguacaagaccugggccuaccacggcuccuacgaggucaagcccagcggguccgcgagcagcauggugaacggcgugguccggcugcugaccaagcccugggacgugauccccauggugacgcagaucgccaugaccgacaccaccccguucgggcagcagcgcgucuucaaggagaagguggacacgcggacccccaaggccaagcgcggcaccgcccagaucauggaggugaccgcccgguggcucuggggcuuccugucccgcaacaagaagccccggaucugcacgcgcgaggaguucacccggaagguccgcagcaacgcggccaucggggccguguucguggacgagaaccaguggaacuccgccaaggaggcggucgaggacgagcgguucugggaccuggugcaccgcgagcgggagcuccacaagcagggcaagugcgcgaccugcguguacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcgucgagggggagggccuccacaagcugggguacauccugcgcgacaucagcaagaucccgggcggcaacauguacgccgacgacaccgccgggugggacacgcggaucaccgaggacgaccuccagaacgaggccaagaucaccgacaucauggagcccgagcacgcccugcuggcgaccuccaucuucaagcucacguaccagaacaagguggugcgcguccagcgccccgccaagaacggcaccgugauggacgugaucagccggcgcgaccagcggggguccggccaggucggcaccuacgggcugaacaccuucacgaacauggaggcccagcugauccgccagauggagagcgagggcaucuucucccccagcgagcucgagaccccgaaccuggccgagcggguguucgacuggcuggagaagcacgggaucgagcgccucaagcggauggccaucuccggcgacgacugcguggucaagcccaucgacgaccgcuucgcgaccgcccugaccgcccugaacgacauggggaaggugcggaaggacaucccccagugggagcccagcaagggcuggaacgacuggcagcaggucccguucugcucccaccacuuccaccagcucaucaugaaggacggccgcgagaucgucgugcccugccggaaccaggacgagcugguggggcgcgcccgggucagccagggcgccggguggagccugcgcgagacggcgugccucggcaaguccuacgcccagauguggcagcugauguacuuccaccggcgcgaccugcggcucgccgccaacgcgaucugcagcgccgugcccguggacuggguccccaccucccgcaccaccuggagcauccacgcccaccaccaguggaugacgaccgaggacaugcuguccguguggaaccggguguggaucgaggagaacccguggauggaggacaagacccacgucagcuccugggaggacgugcccuaccuggggaagcgcgaggaccaguggugcggcagccucaucggccugaccgcccgcgccaccugggcgacgaacauccagguggccaucaaccagguccggcgccugaucgggaacgagaacuaccucgacuacaugaccuccaugaagcgguucaagaacgagagcgaccccgagggcgcccugugguga

SEQ ID NO: 7915 - RNA, 9879 nt, Artificial Sequence
  derived and/or modified CDS sequence (opt1) from DENV-1__AB195673__SS-prME
agcgugaccaugcugcucaugcugcugcccaccgcccucaccuuccaccugaccacccgcggcggggagccccacaugaucgugggcaagcaggagcggggcaagagccugcuguucaagaccagcgccggggugaacaugugcacccugaucgccauggaccugggggagcucugcgacgacaccaugaccuacaagugcccccgcaucaccgagacggagcccgacgacguggacugcuggugcaacgccaccgagaccugggucaccuacggcacgugcagccagaccggcgagcaccggcgcgacaagcggagcguggcccuggcgccccacguggggcugggccucgagacccgcaccgagacguggauguccagcgagggggccuggcggcagauccagaaggucgagaccugggcccugcgccaccccggcuucaccgugaucgcccuguuccucgcccacgugaucgggaccuccaucacgcagaagggcaucaucuucauccugcugaugcucgucacccccagcauggccaugcggugcgugggcaucgggaaccgcgacuucguggagggccuguccggggcgaccugggucgacguggugcuggagcacggcagcugcgucaccacgauggccaaggacaagcccacccucgacaucgagcugcugaagaccgaggugaccaaccccgccgugcuccggaagcugugcaucgaggccaagaucuccaacacgaccaccgacagccgcugcccgacccagggcgaggccacgcuggucgaggagcaggacaccaacuucgugugccggcgcaccuucguggaccggggguggggcaacgggugcggccucuucgggaagggcucccugaucacgugcgcgaaguucaagugcgucacgaagcuggagggcaagaucgugcaguacgagaaccucaaguacagcgugaucgucaccgugcacaccggggaccagcaccaggucggcaacgagaccaccgagcacgggacgaucgccaccaucacgccccaggcccccaccuccgagauccagcugacggacuacggcgcccugacccucgacugcagcccccgcaccgggcuggacuucaacgagauggugcugcucaccaugaaggagaaguccuggcuggugcacaagcagugguuccuggaccucccgcugcccuggacgagcggcgccuccaccagccaggagaccuggaaccggcaggaccugcucgucaccuucaagacggcgcacgccaagaagcaggagguggugguccugggcagccaggagggggccaugcacaccgcccugaccggcgccaccgagauccagacguccgggaccaccaccaucuucgcgggccaccucaagugccgccugaagauggacaagcugacgcucaaggggaucagcuacgugaugugcaccggcuccuucaagcuggagaaggagguggccgagacccagcacggcaccguccugguccaggugaaguacgaggggacggacgcccccugcaagauccccuucagcucccaggacgagaagggcgucacccagaacgggcggcuggugaccgccaacccgaucgugaccgacaaggagaagcccgucaacaucgaggccgagccgcccuucggcgagagcuacaucguggugggcgcgggggagaaggcccucaagcuguccugguucaagaagggcagcuccaucgggaagauguucgaggccacggcccgcggcgcgcggcgcauggccauccugggggacaccgccugggacuucggcagcaucggcggggucuucaccuccgugggcaagcucgugcaccagaucuucgggaccgccuacggcguccuguucagcgggguguccuggacgaugaagaucggcaucggcauccugcucaccuggcuggggcugaacagccgcuccaccagccucuccaugaccugcaucgccgugggccugaucacgcuguaccucggggucauggugcaggcggacagcggcugcgugaucaacuggaaggggcgggagcugaagugcggcuccggcaucuucgucaccaacgaggugcacaccuggaccgagcaguacaaguuccaggccgacagcccgaagcgccugagcgccgccaucgggaaggccugggaggagggcgugugcgggauccgguccgcgacccgccucgagaacaucauguggaagcagaucagcaacgagcugaaccacauccugcucgagaacgacaugaaguucacggucguggugggcgacgucuccgggauccuggcccagggcaagaaguccauccggccccagcccauggagcacaaguacuccuggaaguccuggggcaaggccaagaucaucggggccgacgugcagaacaccaccuucaucaucgacggccccaacaccccggagugccccgacgaccagcgcgccuggaacaucugggagguggaggacuacggguucggcaucuucacgaccaacaucuggcugaagcuccgggacuccuacacccaggucugcgaccaccgccugaugagcgcggccaucaaggacuccaaggccgugcacgccgacaugggcuacuggaucgagagcgagaagaacgagaccuggaagcuggcgcgggccuccuucaucgaggugaagacgugcaucuggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuucaagggcgaggacgggugcugguacggcauggagauccggcccgugaaggagaaggaggagaaccucgucaagagcauggugagcgccggcuccggggagguggacagcuucucccugggccugcucugcaucagcaucaugaucgaggaggucaugcgcucccgguggagccgcaagaugcugaugaccgggacgcuggccguguuccuccugcugaccaugggccagcucaccuggaacgaccugauccggcugugcaucauggugggggcgaacgccuccgacaacaugggcaugggcaccacguaccucgcccugauggccaccuuccgcaugcgcccgauguucgccgucgggcuccuguuccggcgccugaccagccgggaggugcugcuccugaccgucggccugucccucguggcgagcguggagcugcccaacucccuggaggagcucggggacggccuggccaugggcaucaugauccugaagcuccugacggacuuccagagccaccagcugugggccacccuccugucccugaccuucgucaagaccacguucagccuccacuacgccuggaagaccauggccaugauccuguccaucgugagccuguucccccucugccuguccaccaccagccagaagacgaccuggcugcccgugcuccuggggucccugggcugcaagccgcucaccauguuccugaucaccgagaacaagaucugggggcgcaagagcuggccccugaacgagggcaucauggcggucgggaucgugagcauccuccuguccagccugcucaagaacgacgugccccuggccggcccccugaucgccggcgggaugcucaucgccugcuacgucaucuccggcagcuccgcggaccugagccuggagaaggccgccgagguguccugggaggaggaggccgagcacagcggggccucccacaacauccucguggagauccaggacgacggcaccaugaagaucaaggacgaggagcgggacgacacgaucaccauccugcugaaggcgacccuccuggccaucagcggggucuacccgauguccauccccgccacccuguucgugugguacuucuggcagaagaagaagcagcgcagcggcgugcucugggacacgcccagcccgcccgaggucgagcgggccgugcuggacgacggcaucuaccgcauccugcagcgggggcugcucggccgcagccaggugggggucggcguguuccaggaggggguguuccacaccauguggcacgucacccggggcgccgugcugauguaccagggcaagcgccuggagcccuccugggcgagcgugaagaaggaccucaucuccuacgggggcggguggcgguuccagggcagcuggaacaccggggaggagguccaggugaucgccguggagcccggcaagaaccccaagaacguccagacggcccccggcaccuucaagaccuccgagggggaggugggcgccaucgcccuggacuucaagcccgggaccagcggcagccccaucgugaaccgcgagggcaagaucgucgggcuguacggcaacgggguggugacgaccuccggcaccuacgucagcgcgaucgcccaggccaaggccucccaggaggggccccucccggagaucgaggacgagguguuccggaagcgcaaccugaccaucauggaccugcaccccggcagcggcaagacgcggcgcuaccuccccgccaucgugcgggaggcgaucaagcgcaagcugcggacccugguccucgccccgacccgcgugguggccuccgagauggccgaggcgcugaaggggaugcccauccgcuaccagaccacggccgucaagagcgagcacaccggccgggagaucguggaccugaugugccacgccaccuucaccaugcgccuccugucccccgugcggguccccaacuacaacaugaucaucauggacgaggcccacuucacggacccggccagcaucgcggcccgcggguacaucuccacccgggugggcaugggggaggccgccgccaucuucaugaccgcgacgccgcccggcagcguggaggccuucccccaguccaacgccgucauccaggacgaggagaaggacaucccggagcgcagcuggaacuccggcuacgacuggaucacggacuuccccgggaagaccgugugguucgugcccagcaucaaguccggcaacgacaucgccaacugccugcggaagaacgggaagcgcgucauccagcucagccggaagaccuucgacaccgaguaccagaagacgaagaacaacgacugggacuacguggugaccaccgacaucuccgagaugggcgccaacuuccgcgcggaccgggucaucgacccccgccggugccugaagccggugauccugaaggacgggcccgagcgcgucauccucgccggccccaugcccgugaccguggccagcgccgcgcagcggcgcggccggaucgggcgcaaccagaacaaggagggcgaccaguacaucuacauggggcagccgcugaacaacgacgaggaccacgcccacuggacggaggccaagaugcugcucgacaacaucaacacccccgagggcaucauccccgcccuguucgagcccgagcgggagaaguccgccgcgaucgacggggaguaccgccugcgcggcgaggcccggaagaccuucgucgagcucaugcgccggggcgaccugccgguguggcugagcuacaagguggccagcgagggguuccaguacuccgaccgccgguggugcuucgacggcgagcgcaacaaccagguccucgaggagaacauggacguggagaucuggaccaaggagggggagcggaagaagcugcgcccccgguggcuggacgcccgcacguacagcgacccccucgcccugcgggaguucaaggaguucgcggccggccgccgguccgugagcggcgaccugauccucgagaucgggaagcugccccagcaccugacccagcgcgcccagaacgcccucgacaaccuggucaugcugcacaacuccgagcagggcgggaaggccuaccggcacgcgauggaggagcucccggacaccaucgagacccugaugcugcucgcccugaucgccgugcugaccggcggggugacccucuucuuccugagcggccgcggccuggggaagaccuccaucggccuccugugcgucaugagcuccagcgcccugcucuggauggcguccguggagccccacuggaucgccgccagcaucauccuggaguucuuccugauggugcuccugauccccgagcccgaccggcagcgcaccccgcaggacaaccagcuggccuacgucgugaucgggcuccuguucaugauccugaccguggccgcgaacgagaugggccuccuggagacgaccaagaaggaccuggggaucggccacgccgccgccgagaaccaccaccacgccgcgaugcucgacgucgaccugcaccccgccuccgccuggacccuguacgccguggccaccacgaucaucacccccaugaugcggcacaccaucgagaacaccacggcgaacaucagccucaccgccaucgccaaccaggccgccauccugaugggccuggacaagggguggccgaucuccaagauggacaucggcgugccccuccuggcgcuggggugcuacagccaggucaacccccucacccugaccgccgccgugcugaugcucguggcccacuacgcgaucaucggccccgggcugcaggccaaggccacgcgcgaggcccagaagcggaccgccgcgggcaucaugaagaacccgaccgucgacggcaucguggccaucgaccuggaccccguggucuacgacgccaaguucgagaagcagcucgggcagaucaugcugcugauccucugcaccucccagauccugcugaugcgcacgaccugggcccucugcgagagcaucacccuggccaccggcccccugacgacccucugggaggggucccccggcaaguucuggaacaccaccaucgcggugagcauggccaacaucuuccgcggcagcuaccuggccggggccggccuggccuucucccucaugaagucccucgggggcgggcggcgcggcacgggcgcgcagggggagacccugggcgagaaguggaagcggcagcucaaccagcuguccaagagcgaguucaacaucuacaagcgcuccgggaucguggaggucgaccggagcgaggccaaggagggccugaagcgcggggagaccaucaagcacgccgugucccggggcaccgccaagcuccgcugguucguggagcggaaccuggucaagccggagggcaaggugaucgaccuggggugcggccgcgggggcuggagcuacuacugcgcggggcugaagaaggugacggaggucaagggcuacaccaagggcgggcccggccacgaggagcccauccccauggccaccuacggguggaaccucgugaagcuguacuccggcaaggacguguucuucaucccgcccgagaagugcgacacccugcucugcgacaucggggagagcucccccaaccccacgaucgaggagggccggacccugcgcguccugaagaugguggagccguggcuccggggcaaccaguucugcaucaagauccugaaccccuacaugcccagcguggucgagacccuggagcagaugcagcgcaagcacgggggcaugcucgugcggaacccccugucccgcaacagcacccacgagauguacuggguguccugcgggaccggcaacaucgucagcgccgugaacaugacgucccggaugcugcucaaccgcuucaccauggcccaccggaagccgaccuacgagcgcgacguggaccugggcgccgggacccgccacgucgcgguggagcccgagguggccaaccuggacaucaucggccagcggaucgagaacaucaagaacgagcacaagagcacguggcacuacgacgaggacaaccccuacaagaccugggccuaccacggguccuacgaggucaagcccagcggcagcgccuccagcauggugaacggggucgugcgccuccugaccaagccgugggacgugauccccauggucacccagaucgccaugacggacaccacccccuucggccagcagcggguguucaaggagaagguggacacccgcacgcccaaggcgaagcggggcaccgcccagaucauggaggucaccgccaaguggcuguggggguuccucucccgcaacaagaagccgcggaucugcacccgcgaggaguucacgcggaaggugcgcagcaacgccgccaucggcgcgguguucgucgacgagaaccaguggaacuccgccaaggaggccguggaggacgagcgguucugggaccuggugcgccgggagcgcgagcugcacaagcaggggaagugcgcgaccugcgucuacaacaugaugggcaagcgggagaagaagcucggggaguucggcaaggcgaagggcagccgcgccaucugguacauguggcugggggcccgguuccuggaguucgaggcccucggcuucaugaacgaggaccacugguucucccgcgagaacagccuguccgggguggagggcgaggggcugcacaagcucggcuacauccugcgggacaucagcaagauccccggcgggaacauguacgccgacgacaccgcgggcugggacacccgcaucacggaggacgaccugcagaacgaggccaagaucaccgacaucauggagcccgagcacgcccuccuggccaccuccaucuucaagcugaccuaccagaacaaggugguccgggugcagcgcccggccaagaacgggacggugauggacgucaucagccgccgggaccagcgcggcuccggccagguggggaccuacggccucaacaccuucaccaacaugggggcgcagcugauccggcagauggagagcgagggcaucuucucccccagcgagcuggagacgcccaaccucgccgggcgcgugcuggacuggcuggagaagcacggcaucgagcggcuccgccggauggccaucuccggcgacgacugcgucgugaagcccaucgacgaccgcuucgccaccgcccugaccgcgcugaacgacauggggaaggugcggaaggacaucccgcagugggagcccagcaagggcuggaacgacuggcagcagguccccuucugcagccaccacuuccaccagcucaucaugaaggacgggcgcgagaucguggugcccugccggaaccaggacgagcuggucggccgcgcccgggugucccagggggccggcuggagccugcgcgagaccgccugccucggcaaguccuacgcccagauguggcagcugauguacuuccaccggcgcgaccugcggcucgcggccaacgccaucugcagcgccgugccggucgacugggugcccacgucccgcaccaccuggagcauccacgcgcaccaccaguggaugaccacggaggacaugcuguccguguggaaccgggucuggaucgaggagaaccccuggauggaggacaagacccacgugagcuccugggaggacgugcccuaccuggggaagcgcgaggaccaguggugcggcagccucaucgggcugaccgcccgcgccaccugggccaccaacauccaggucgccaucaaccaggugcggcgccugaucggcaacgagaacuaccucgacuacaugacguccaugaagcgguucaagaacgagagcgacccggagggggcgcugugguga

SEQ ID NO: 7916 - RNA, 9879 nt, Artificial Sequence
  derived and/or modified CDS sequence (opt1) from DENV-1__AB204803__SS-prME
agcgugaccaugcugcucaugcugcugcccaccgugcucaccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccgcaucaccgagaccgagcccgacgacguggacugcuggugcaacgccaccgagaccugggugaccuacgggacgugcagccagaccggcgagcaccggcgcgacaagcgguccguggcccuggcgccccacgucggccuggggcucgagacccgcaccgagacguggaugagcuccgagggcgccuggaagcagauccagaagguggagaccugggcccugcggcacccgggguucaccgugaucgcgcuguuccucgcccacgccaucggcaccagcaucacgcagaaggggaucaucuucauccugcugaugcucgucacccccuccauggccaugcgcugcgugggcaucggcaaccgggacuucguggaggggcugagcggcgcgaccugggucgacguggugcuggagcacggguccugcgucaccacgauggccaaggacaagcccacccucgacaucgagcugcugaagaccgaggugaccaaccccgccgugcuccgcaagcugugcaucgaggccaagaucagcaacacgaccaccgacucccggugcccgacccagggcgaggccacgcuggucgaggagcaggacaccaacuucgugugccgccggaccuucguggaccgcggcugggggaacggcugcggccucuucggcaaggggagccugaucacgugcgucaaguucaagugcgugacgaagcuggagggcaagaucgugcaguacgagaaccucaaguacuccgucaucgugaccguccacaccggcgaccagcaccagguggggaacgagaccaccgagcacggcacgaucgcgaccaucacgccccaggcccccaccagcgagauccagcugacggacuacggggcccugacccucgacugcagcccccggaccggccuggacuucaacgagauggugcugcucaccaugaaggagaaguccuggcugguccacaagcagugguuccuggaccucccgcugcccuggacguccggggccagcaccagccaggagaccuggaaccgccaggaccugcucgugaccuucaagacggcccacgcgaagaagcaggagguggucgugcugggcucccaggagggcgccaugcacaccgcccugaccggggccaccgagauccagacgagcggcaccaccaccaucuucgccgggcaccucaagugccggcugaagauggacaagcugacgcucaagggcaccuccuacgugaugugcaccgggcccuucaagcuggagaaggaggucgcggagacccagcacggcacggugcuggugcaggucaaguacgagggcaccgacgcccccugcaagaucccguucagcucccaggacgagaagggggugacccagaacggccgccugaucaccgccaaccccaucgugacggacaaggagaagcccaucaacaucgaggccgagcccccguucggggagagcuacaucgucgugggcgugggcgagaaggcccucaagcuguccugguucaagaaggggagcuccaucggcaagauguucgaggcgaccgcccgcggggcccgccggauggccauccugggcgacaccgcgugggacuucgggagcaucggcggcgucuucaccuccauggggaagcucgugcaccagaucuucggcacggccuacggggugcuguucagcggcgucuccuggaccaugaagaucgggaucggcauccugcucaccuggcugggccugaacagccgcuccaccagccucuccaugacgugcaucgccguggggauggugacccuguaccugggcgucauggugcaggccgacagcgggugcgugaucaacuggaagggccgcgagcucaagugcggguccggcaucuucgucaccaacgaggugcacaccuggaccgagcaguacaaguuccaggccgacagccccaagcggcugagcgcggccaucggcaaggccugggaggagggggugugcggcauccgcuccgccacgcggcuggagaacaucauguggaagcagaucagcaacgagcucaaccacauccugcuggagaacgacaugaaguucaccgucguggugggggacgucuccggcauccucgcccaggggaagaagaugauccgcccccagcccauggagcacaaguacagcuggaaguccuggggcaaggcgaagaucaucggcgccgacgugcagaacaccaccuucaucaucgacgggccgaacacgcccgagugcagcgacgaccagcgggccuggaacaucugggagguggaggacuacggcuucgggaucuucaccaccaacaucuggcugaagcugcgcgacuccuacacccaggucugcgaccaccggcucaugagcgccgccaucaaggacucccgcgcggugcacgccgacaugggcuacuggaucgagagcgagaagaacgagacguggaagcuggcccgggccuccuucaucgaggugaagaccugcaucuggcccaagagccacacccugugguccaacggcguccucgagagcgagaugaucauccccaagaucuacgggggcccgaucucccagcacaacuaccgccccggguacuucacccagacggcgggccccuggcaccuggggaagcuggagcucgacuucgaccugugcgagggcaccaccgugguggucgacgagcagugcggcaaccgggggccgagccugcgcaccacgaccgugaccggcaagaucauccacgaguggugcugccgguccugcacccugccgccccugcgcuucaagggggaggacggcugcugguacgggauggagauccggcccgugaaggagaaggaggagaaccuggucaagagcauggugagcgccggcuccggcgagguggacagcuucucccucgggcugcugugcaucagcaucaugaucgaggaggucaugcgcucccgguggagccgcaagaugcucaugacgggcacccuggccguguuccugcuccugaccauggggcagcugaccuggaacgaccucauccggcugugcaucauggugggcgccaacgccuccgacaagauggggaugggcacgaccuaccuggcccucauggccaccuuccgcaugcgcccgauguucgccgucgggcugcuguuccgggggcucaccagccgcgaggugcugcugcucacggucggccugucccugguggccagcguggagcuccccaacucccuggaggagcugggggacggccucgccaugggcaucaugaugcugaagcugcucaccgacuuccagagccaccagcugugggcgacccugcucucccugaccuucgucaagacgaccuucagccugcacuacgccuggaagaccauggccaugacccucuccaucgugagccuguucccccugugccucuccacgaccagccagaagaccaccuggcugcccgugcugcucgggucccugggcugcaagccgcugaccauguuccucaucacggagaacaagaucugggggcggaaguccuggccccugaacgagggcaucauggccgucgggaucgugagcauccugcucuccagccugcugaagaacgacgugccccucgccggcccccugaucgcgggcgggaugcugaucgccugcuacgucaucuccggcagcuccgccgaccucagccuggagaaggccgcggagguguccugggaggaggaggccgagcacagcggggccucccacaacauccugguggagguccaggacgacggcaccaugaagaucaaggacgaggagcgcgacgacaccaucaccauccuccugaaggccacgcugcucgccaucagcgggguguacccgauguccauccccgcgacccuguucgugugguacuucuggcagaagaagaagcagcggagcggcguccugugggacacccccagcccgcccgagguggagcgcgccgugcucgacgacggcaucuaccggauccugcagcgcgggcugcugggccggagccaggucggggugggcguguuccaggagggggucuuccacaccauguggcacgugacgcgcggcgccgugcucauguaccagggcaagcggcuggagcccuccugggccagcgucaagaaggaccugaucuccuacgggggcggguggcgcuuccagggcagcuggaacaccggggaggagguccaggugaucgccgucgagcccggcaagaaccccaagaacgugcagaccgcgcccggcaccuucaagacguccgagggggaggugggcgccaucgcccucgacuucaagcccgggaccagcggcagccccaucgucaaccgggagggcaagaucguggggcuguacggcaacgggguggucaccaccuccggcacguacgugagcgccaucgcccaggcgaaggccucccaggaggggccccugccggagaucgaggacgagguguuccgcaagcggaaccucaccaucauggaccugcaccccggcagcggcaagacccgccgguaccugcccgccaucguccgcgaggccaucaagcggaagcuccgcacccuggugcuggccccgacgcggguggucgcguccgagauggccgaggcccucaaggggaugcccauccgcuaccagaccaccgccgucaagagcgagcacaccggcaaggagaucguggaccugaugugccacgcgacguucaccaugcgccugcucucccccguccgggugcccaacuacaacaugaucaucauggacgaggcccacuucaccgacccggccagcaucgccgcccgcggguacaucuccacccgggugggcaugggggaggcggccgccaucuucaugacggccacgccgcccggcagcgucgaggccuucccccaguccaacgcggugauccaggacgaggagaaggacaucccggagcgcagcuggaacuccggcuacgacuggaucaccgacuuccccgggaagaccgugugguucguccccagcaucaaguccggcaacgacaucgccaacugccugcggaagaacgggaagcgcgugauccagcugagccggaagacguucgacaccgaguaccagaagaccaagaacaacgacugggacuacguggucaccacggacaucuccgagaugggcgccaacuuccgcgccgaccgggugaucgacccccgccggugccucaagccggucauccugaaggacgggcccgagcgcgugauccuggccggccccaugcccgugaccgucgcgagcgccgcccagcggcgcggccggaucgggcgcaaccagaacaaggagggcgaccaguacaucuacauggggcagccgcucaacaacgacgaggaccacgcccacuggaccgaggcgaagaugcugcuggacaacaucaacacccccgagggcaucauccccgcccucuucgagcccgagcgggagaaguccgccgccaucgacggggaguaccgccugcggggcgaggcccgcaagacguucguggagcugaugcgccggggcgaccucccgguguggcugagcuacaaggucgcgagcgagggguuccaguacuccgaccgccgguggugcuucgacggcgagcgcaacaaccaggugcuggaggagaacauggacguggagaucuggaccaaggagggggagcggaagaagcuccgcccccgguggcuggacgcccgcaccuacagcgacccccuggcccuccgggaguucaaggaguucgccgccggccgccgguccgucagcggcgaccugauccuggagaucgggaagcucccccagcaccugacccagaaggcgcagaccgcccuggacaaccucgugaugcugcacaacuccgagcagggcgggaaggccuaccgccacgccauggaggagcugccggacacgaucgagacccucaugcugcuggcccucaucgcggugcugaccggcggggucacccuguucuuccucagcggcaagggccuggggaagacguccaucggccugcucugcgugaugagcuccagcgcccugcuguggauggccuccguggagccccacuggaucgccgcgagcaucauccucgaguucuuccugaugguccugcucauccccgagcccgaccggcagcgcaccccgcaggacaaccagcuggccuacguggugaucgggcuccucuucaugauccugaccgucgccgccaacgagaugggccugcucgagaccacgaagaaggaccuggggaucggccacgccgcggccgagaaccaccaccacgccgccaugcuggacguggaccuccaccccgccuccgcguggacccuguacgccguggccaccaccaucaucacgcccaugaugcggcacaccaucgagaacaccaccgccaacaucagccugacggccaucgcgaaccaggccgccauccucaugggccuggacaagggguggccgaucuccaagauggacaucggcgucccccugcucgcccuggggugcuacagccaggugaacccccugacccucaccgccgcggugcugaugcuggucgcccacuacgccaucaucggccccgggcuccaggccaaggcgacccgcgaggcccagaagcggacggccgccggcaucaugaagaacccgaccguggacggcaucguggccaucgaccuggaccccgucguguacgacgcgaaguucgagaagcagcuggggcagaucaugcuccugauccugugcaccucccagauccuccugaugcgcaccacgugggcccugugcgagagcaucacccucgccaccggcccccugaccacgcugugggaggggucccccggcaaguucuggaacaccaccaucgccgugagcauggccaacaucuuccggggcagcuaccucgcgggggccggccuggccuucucccugaugaagucccucgggggcgggcgccggggcaccggcgcccagggggagacgcugggcgagaaguggaagcgccagcugaaccagcucuccaagagcgaguucaacaccuacaagcgcuccgggaucauggaggucgaccggagcgaggccaaggagggccugaagcgcggggagaccaccaagcacgcggugucccggggcacggccaagcugcgcugguucguggagcggaaccucgucaagccggagggcaaggugaucgaccuggggugcggccgcgggggcuggagcuacuacugcgccgggcugaagaaggugaccgaggucaagggcuacaccaagggcgggcccggccacgaggagcccauccccauggccaccuacggguggaaccuggugaagcuccacuccggcaaggacguguucuucaucccgcccgagaagugcgacacccugcugugcgacaucggggagagcucccccaaccccacgaucgaggagggccggacccuccgcguccugaagaugguggagccguggcugcggggcaaccaguucugcaucaagauccucaaccccuacaugcccagcguggucgagacccuggagcagaugcagcgcaagcacgggggcaugcuggugcggaacccccucucccgcaacagcacccacgagauguacuggguguccugcgggacgggcaacaucgucagcgcggugaacaugaccucccggaugcugcugaaccgcuucaccauggcccaccggaagccgaccuacgagcgcgacguggaccucggcgccgggacgcggcacgucgccguggagcccgagguggccaaccuggacaucaucggccagcgcaucgagaacaucaagaacgagcacaagagcaccuggcacuacgacgaggacaaccccuacaagaccugggcguaccacggguccuacgagguccggcccagcggcagcgccuccagcauggugaacggggucgugcgccugcucaccaagccgugggacgugauccccauggucacgcagaucgccaugaccgacaccacccccuucggccagcagcgcguguucaaggagaagguggacacgcggacccccaaggccaagcgcggcaccgcccagaucauggaggucaccgcgaaguggcuguggggguuccugucccggaacaagaagccgcgcaucugcacgcgggaggaguucacccgcaaggugcggagcaacgccgccaucggcgccguguucgucgacgagaaccaguggaacuccgccaaggaggcgguggaggacgagcgcuucugggaccucgugcaccgggagcgcgagcugcacaagcaggggaagugcgcgaccugcgucuacaacaugaugggcaagcgggagaagaagcugggggaguucggcaaggccaagggcagccgcgccaucugguacauguggcucggggcgcgguuccuggaguucgaggcccugggcuucaugaacgaggaccacugguucucccgcgagaacagccucuccgggguggagggcgaggggcugcacaagcugggcuacauccuccgggacaucagcaagauccccggcgggaacauguacgccgacgacaccgccggcugggacacgcgcaucaccgaggacgaccugcagaacgaggccaagaucaccgacaucauggagcccgagcacgcgcugcucgccaccuccaucuucaagcugacguaccagaacaaggugguccgggugcagcgcccggccaagagcgggaccgugauggacgucaucucccggcgcgaccagcggggcagcggccagguggggaccuacggccugaacaccuucacgaacauggaggcccagcucauccgccagauggaguccgaggggaucuucagccccuccgagcuggagacccccaaccuggccggccgcgugcucgacuggcuggagaagcacgggaucgagcggcugaagcgcauggcgaucagcggcgacgacugcgucgugaagcccaucgacgaccgguucgccaccgcccucaccgcccugaacgacaugggcaaggugcgcaaggacaucccgcagugggagcccagcaagggguggaacgacuggcagcagguccccuucugcucccaccacuuccaccagcugaucaugaaggacggccgggagaucguggugcccugccgcagccaggacgagcucgucgggcgggcccgcgugucccagggcgcgggguggagccugcgggagacggccugccugggcaaguccuacgcccagauguggcagcucauguacuuccaccgccgggaccugcgccuggccgccaacgcgaucugcagcgccgugccggucgacugggugcccaccucccggaccaccuggagcauccacgcccaccaccaguggaugaccacggaggacaugcucuccguguggaaccgcgucuggaucgaggagaaccccuggauggaggacaagacccacgugagcuccugggaggacgugcccuaccugggcaagcgggaggaccaguggugcgggagccugaucggccucaccgcccgcgcgaccugggccacgaacauccaggucgccaucaaccaggugcggcgccugaucgggaacgagaacuaccuggacuacaugaccuccaugaagcgguucaagaacgagagcgacccggagggcgcccucugguga

SEQ ID NO: 7917 - RNA, 9879 nt, Artificial Sequence
  derived and/or modified CDS sequence (opt1) from DENV-1__LC016760__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuaccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccaucgcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcggaagcugcgcacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggcaaggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccuccgcguggacccuguacgccguggccacgaccaucaucaccccgaugaugcgccacaccaucgagaacacgaccgccaacaucagccucaccgccaucgcgaaccaggccgccauccugauggggcuggacaagggcuggcccaucuccaagauggacaucggcgucccccuccuggcccuggggugcuacagccaggugaacccccucacccugacggcggccgugcugaugcucgucgcccacuacgccaucaucggcccggggcugcaggccaaggcgacccgggaggcccagaagcgcaccgccgccggcaucaugaagaaccccaccguggacgggaucguggccaucgaccuggaccccgucguguacgacgcgaaguucgagaagcagcucggccagaucaugcugcugauccucugcacgucccagauccugcugaugcgcaccaccugggcccucugcgagagcaucacccuggccacgggcccccugaccacccucugggagggguccccgggcaaguucuggaacaccacgaucgccgugagcauggccaacaucuuccggggguccuaccuggcgggcgccggccuggccuucagccucaugaagucccucgggggcgggcgccgggggaccggggcccagggcgagacccugggcgagaaguggaagcgccagcucaaccagcuguccaagagcgaguucaacaccuacaagcgguccgggaucauggaggucgaccgcagcgaggcgaaggagggccugaagcgcggggagacgaccaagcacgccgugucccgcggcaccgccaagcuccggugguucguggagcgcaaccuggucaagcccgaggggaaggugaucgaccugggcugcggccgcgggggcuggagcuacuacugcgccgggcugaagaaggugaccgaggucaagggcuacacgaagggcggccccggccacgaggagcccgugccgauggccaccuacggguggaaccucgugaagcugcacuccggcaaggacgucuucuucaucccgcccgagaagugcgacacccugcucugcgacaucggggagagcucccccaacccgaccaucgaggagggccgcacgcugcgggugcugaagaugguggagcccuggcuccgcgggaaccaguucugcaucaagauccugaaccccuacaugcccagcgucguggagacccuggagcagaugcagcggaagcacggcggcaugcucgugcgcaacccgcugucccggaacagcacccacgagauguacugggucuccugcgggaccggcaacaucgugagcgcgaucaacaugaccucccgcaugcugcucaaccgguucacgauggcccaccgcaagcccaccuacgagcgcgacguggaccugggggccggcacccggcacgucgccguggagcccgagguggccaaccuggacaucaucggccagcgcaucgagaacaucaagugcgagcacaagagcaccuggcacuacgacgaggacaaccccuacaagacgugggcguaccacggguccuacgaggucaagccgagcggcuccgccagcagcauggugaacggggucgugaagcuccugaccaagcccugggacgugauccccauggucacccagaucgccaugaccgacacgacccccuucggccagcagcggguguucaaggagaagguggacacccgcaccccgaaggccaagcgggggacggcccagaucauggaggucaccgcgcgcuggcuguggggcuuccucucccggaacaagaagccccgcaucugcacccgggaggaguucacccgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggagccgcgccaucugguacauguggcugggcgcgcgguuccuggaguucgaggcccucggcuucaugaacgaggaccacugguucucccgcgagaacagccuguccgggguggagggcgaggggcugcacaagcucggcuacauccugcgggacaucagcaagaucuccgggggcaacauguacgccgacgacaccgccggcugggacacccgcaucaccgaggacgaccugcagaacgaggccaagaucacggagaucauggagcccgagcacgcgcagcucgccaaggccaucuucaagcugaccuaccagaacaaggugguccgggugcagcgcccggccaagaacgggaccgugauggacgucaucagccgccgggaccagcgcggcuccggccagguggggaccuacggccugaacacguucaccaacauggaggcccagcucauccggcagauggagagcgaggggaucuucucccccagcgagcuggagacccccaaccuggcggagcgcgugcucgacuggcuggagaaguacggcgucgagcggcugaagcgcauggccaucuccggggacgacugcguggugaagcccaucgacgaccgguucgccaccgcccucacggcccugaacgacaugggcaagguccgcaaggacaucccgcagugggagcccagcaagggguggaacgacuggcagcagguccccuucugcucccaccacuuccaccagcugaucaugaaggacggccgggagaucgugguccccugccgcaaccaggacgagcucgugggccgggcgcgcgugagccagggggccggcuggagccugcgggagaccgccugccuggggaaguccuacgcccagauguggcagcucauguacuuccaccgccgggaccugcgccuggcggccaacgccaucugcagcgccgucccgguggacugggugcccaccucccggaccacguggagcauccacgcccaccaccaguggaugaccaccgaggacaugcucuccgucuggaaccgcguguggaucgaggagaaccccuggaugaaggacaagacccacaucagcuccugggaggacgugcccuaccugggcaagcgggaggaccaguggugcgggagccugaucggccucacggcgcgcgccaccugggccaccaacauccaggucgccaucaaccaggugcgccggcugaucggcaacgagaacuaccuggacuacaugaccuccaugaagcgcuucaagaacgagagcgacccggagggggcccucugguga

SEQ ID NO: 7918 - RNA, 9879 nt, Artificial Sequence
  derived and/or modified CDS sequence (opt1) from DENV-1__LC128301__SS-prME
agcgugaccaugcugcucaugcugcugcccaccgcccucgccuuccaccugaccacccgcggcggggagccccacaugaucgugagcaagcaggagcggggcaagagccugcuguucaagaccuccgccggggugaacaugugcacccugaucgccauggaccugggcgagcucugcgaggacaccaugaccuacaagugcccccgcaucaccgagaccgagcccgacgacguggacugcuggugcaacgccaccgagaccugggucaccuacgggaccugcagccagaccggcgagcaccggcgcgacaagcgguccguggcccuggcgccccacgugggccuggggcucgagacccgcaccgagaccuggaugagcuccgagggcgcguggcggcagauccagaaggucgagacgugggcccugcgccaccccggguucaccgugaucgcccuguuccucgcccacgcgaucggcaccagcaucacccagaaggggaucaucuucauccugcugaugcucgugacgcccuccauggccaugcggugcgucggcaucggcaaccgcgacuucguggaggggcugagcggcgccaccuggguggacgucgugcuggagcacggguccugcgugaccaccauggccaaggacaagcccacgcucgacaucgagcugcugaagaccgaggucaccaaccccgccgugcuccggaagcugugcaucgaggcgaagaucagcaacaccacgaccgacucccgcugccccacccagggcgaggccacccugguggaggagcaggacacgaacuucgucugccggcgcaccuucguggaccggggcugggggaacggcugcggccuguucggcaaggggagccugaucacgugcgccaaguucaagugcgugaccaagcuggagggcaagaucguccaguacgagaaccucaaguacuccgugaucgugacgguccacaccggcgaccagcaccagguggggaacgagaccaccgagcacggcaccacggccaccaucacgccccaggcccccaccagcgagauccagcugacggacuacggggcgcugacccucgacugcagcccccgcaccggccuggacuucaacgagaugguccugcucaccaugaaggagaaguccuggcuggugcacaagcagugguuccuggaccucccgcugcccuggacguccggggccagcaccagccaggagaccuggaaccggcaggaccugcucgugaccuucaagacggcccacgccaagaagcaggaggucguggugcugggcucccaggagggcgccaugcacaccgcgcugaccggggccaccgagauccagacgagcggcaccaccaccaucuucgccgggcaccucaagugccgccugaagauggacaagcugacgcucaagggcgucuccuacgugaugugcaccgggagcuucaagcuggagaaggagguggccgagacccagcacggcaccguccugguccaggugaaguacgagggcacggacgcccccugcaagauccccuucuccagccaggacgagaagggggucacccagaacggccggcugaucaccgcgaacccgaucgugaccgacaaggagaagcccgugaacaucgaggccgagccgcccuucggggaguccuaccucgucgugggcgccggcgagaaggcccugaagcugagcugguucaagaagggguccagcaucggcaagauguucgaggcgacggcccgcggggcccggcgcauggccauccucggcgacaccgccugggacuucggguccaucggcggcguguucaccagcgucgggaagcugauccaccagaucuucggcaccgcguacggggugcuguucuccggcgugagcuggacgaugaagaucgggaucggcauccuccugaccuggcugggccucaacucccgcagcaccucccugagcaugaccugcaucgccgucgggauggugacgcuguaccucggcgugaugguccaggccgacuccgggugcgugaucaacuggaagggccgggagcugaagugcgggagcggcaucuucgugaccaacgagguccacaccuggaccgagcaguacaaguuccaggccgacagcccgaagcgccuguccgccgcgaucggcaaggccugggaggagggggugugcggcauccggagcgccacccgccucgagaacaucauguggaagcagaucuccaacgagcugaaccacauccugcucgagaacgacaugaaguucacgguggucgugggggacgugaacggcauccuggcccaggggaagaagaugauccggccccagcccauggagcacaaguacagcuggaaguccuggggcaaggccaaggucaucggcgcggacgugcagaacaccaccuucaucaucgacgggcccaacaccccggagugccccgacgaccagcgcgccuggaacaucugggagguggaggacuacggcuucgggaucuucacgaccaacaucuggcugaagcuccgggacagcuacacccaggucugcgaccaccgccugauguccgccgccaucaaggacagcaaggcggugcacgccgacaugggcuacuggaucgaguccgagaagaacgagaccuggaagcugacgcgggccagcuucaucgaggugaagaccugcaucuggcccaagucccacacccucuggagcaacggcguccuggaguccgagaugaucauccccaagaccuacgggggcccgaucagccagcacaacuaccgccccggguacuucacgcagaccgccggccccuggcaccuggggaagcucgagcuggacuucggccugugcgagggcaccaccgugguggucgacgagcacugcgggaaccggggcccgucccuccgcacgaccaccgugaccgggaagaucauccacgaguggugcugccggagcugcacgcugccgccccugcgcuucaagggcgaggacgggugcugguacggcauggagauccggcccgugaaggagaaggaggagaaccucguccgcuccauggugagcgccggcagcggggagguggacuccuucagccugggccugcucugcaucuccaucaugaucgaggaggucaugcggagccgcuggucccggaagaugcugaugaccgggacccuggcgguguuccuccugcugaucaugggccagcucaccuggaacgaccugauccgccugugcaucauggugggggccaacgccagcgacaagaugggcaugggcacgaccuaccucgcccugauggccaccuuccgcaugcggccgauguucgccgucgggcuccucuuccgccggcugaccucccgcgaggugcugcuccugacggucgggcugagccucguggccuccguggagcugcccaacagccuggaggagcucggggacggccuggccaugggcaucaugaugcugaagcuccugaccgacuuccagucccaccagcugugggccgcccuccugagccugaccuucgucaagaccacguucucccuccacuacgcguggaagaccauggccaugauccugagcaucaucucccuguucccccucugcaugagcaccaccucccagaagacgaccuggcugcccgugcugcucgggagccugggcugcaagccgcugaccauguuccucaucaccgagaacaagaucugggggcggaaguccuggccccugaacgagggcaucauggccguggggaucgucagcauccugcucagcucccugcugaagaacgacgugccccucgccggcccccugaucgcgggcgggaugcugaucgccugcuacgugaucagcggcuccagcgccgaccucucccuggagaaggccgccgaggucagcugggaggaggaggcggagcacuccggggccagccacaacauccugguggaggugcaggacgacggcaccaugaagaucaaggacgaggagcgcgacgacacgcucaccauccugcugaaggccacccuccuggccaucuccggggucuacccgaugagcauccccgccacccuguucgugugguacuucuggcagaagaagaagcagcgguccggcgugcucugggacacgcccagcccgcccgaggucgagcgcgcggugcuggacgacggcaucuaccggauccugcagcgcgggcugcucggcaagucccaggugggggucggcguguuccaggaggggguguuccacaccauguggcacgucacccggggcgccgugcugauguaccagggcaagcgccuggagcccagcugggccuccgugaagaaggaccucaucagcuacgggggcggguggcgguuccagggcuccuggaacaccggggaggagguccaggugaucgccguggagcccggcaagaaccccaagaacguccagacggcccccggcaccuucaagacccccgagggggaggugggcgcgaucgcccuggacuucaagcccgggaccagcggcucccccaucgugaaccgcgagggcaagaucgucgggcuguacggcaacgggguggugacgaccagcggcaccuacgucagcgccaucgcccaggccaaggcgucccaggaggggccgcuccccgagaucgaggacgagguguuccggaagcgcaaccugaccaucauggaccugcaccccggcagcggcaagacgcggcgcuaccucccggccaucgugcgggaggccaucaagcgcaagcugcggacccugguccucgcccccacccgcgugguggcguccgagauggccgaggcccugaaggggaugcccauccgcuaccagaccacggccgucaagagcgagcacaccggcaaggagaucguggaccugaugugccacgccaccuucaccaugcggcuccugucccccgugcgcgucccgaacuacaacaugaucaucauggacgaggcgcacuucacggaccccgccagcaucgccgcccggggguacaucuccacccgcgugggcaugggggaggccgcggccaucuucaugaccgccacgccgcccggcagcauggaggccuucccgcaguccaacgccgcgauccaggacgaggagcgggacauccccgagcgcagcuggaacuccggcuacgacuggaucacggacuuccccgggaagaccgugugguucguccccagcaucaaguccggcaacgacaucgccaacugccugcggaagaacgggaagcgcguggugcagcucagccggaagaccuucgacaccgaguaccagaagacgaagaacaacgacugggacuacgucgugaccaccgacaucuccgagaugggcgccaacuuccgcgccgaccgggugaucgacccgcgccggugccugaagcccgucauccugaaggacgggcccgagcgcgugauccucgcgggccccaugccggucaccguggccagcgccgcccagcggcgcggccggaucgggcgcaaccagaacaaggagggcgaccaguacaucuacauggggcagccccugaacaacgacgaggaccacgcccacuggacggaggcgaagaugcugcucgacaacaucaacacccccgagggcaucauccccgcccuguucgagccggagcgggagaaguccgccgccaucgacggggaguaccgccugcgcggcgaggcccggaagaccuucguggagcucaugcgccggggcgaccugcccgucuggcugagcuacaagguggcguccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcccgcacguacagcgacccccucgcccugcgggaguucaaggaguucgccgccggccgccgguccgugagcggcgaccugauccucgagaucgggaagcugccgcagcaccugacccagcgcgcgcagaacgcccucgacaaccuggugaugcugcacaacuccgagcagggcgggaaggccuaccggcacgccauggaggagcuccccgacaccaucgagacccugaugcugcucgcgcugaucgccguccugaccggcggggugacccucuucuuccugagcggccgcggccuggggaagaccuccaucggccuccugugcgugauggccagcuccgcccugcucuggauggccagcgucgagccccacuggaucgcggccuccaucauccuggaguucuuccugauggugcuccugauccccgagccggaccggcagcgcacgccccaggacaaccagcuggccuacguggucaucgggcuccuguucaugauccugaccguggccgccaacgagaugggccuccuggagacgaccaagaaggaccuggggaucggccacguggcggccgagagccaccaccacgccgccaugcucgacgucgaccugcaccccgccuccgcguggacccuguacgccguggccaccacgaucaucaccccgaugaugcggcacaccaucgagaacaccacggccaacaucagccucaccgccaucgcgaaccaggccgccauccugaugggccuggacaagggguggcccaucuccaagauggacaucggcgugccccuccuggcccuggggugcuacagccaggucaacccccucacccugaccgcggccgugcugaugcucguggcccacuacgccaucaucggcccggggcugcaggccaaggcgacgcgcgaggcccagaagcggaccgccgccggcaucaugaagaaccccaccgucgacggcaucguggccaucgaccuggaccccguggucuacgacgcgaaguucgagaagcagcucgggcagaucaugcugcugauccucugcaccucccagauccugcugaugcgcacgaccugggcccucugcgagagcaucacccuggccaccggcccccugacgacccucugggagggguccccgggcaaguucuggaacaccaccaucgccgugagcauggccaacaucuuccgcggcuccuaccuggcgggggccggccuggccuucagccucaugaagucccucgggggcgggcggcgcgggacgggcgcccagggggagacccugggcgagaaguggaagcggcagcucaaccagcuguccaagagcgaguucaacaccuacaagcgcuccgggaucauggagguggaccggagcgaggcgaaggagggccugaagcgcggggagaccacgaagcacgccgucucccggggcaccgccaagcuccgcugguucguggagcggaaccuggugaagcccgagggcaaggucaucgaccuggggugcggccgcgggggcuggagcuacuacugcgccgggcugaagaaggugaccgaggugaagggcuacaccaagggcgggcccggccacgaggagcccaucccgauggccacguacggguggaaccucgucaagcuguacuccggcaaggacguguucuucacgccgcccgagaagugcgacacccugcucugcgacaucggggagagcucccccaacccgaccaucgaggagggccggacccugcgcgugcugaagauggucgagcccuggcuccggggcaaccaguucugcaucaaggugcugaaccccuacaugcccagcguggucgagacgcuggagcagaugcagcgcaagcacgggggcaugcucgugcggaacccgcugucccgcaacagcacccacgagauguacuggguguccugcgggaccggcaacaucgucagcgcggugaacaugaccucccggaugcugcucaaccgcuucacgaugacccaccggaagcccaccuacgagaaggacguggaccugggcgccgggacccgccacgucgccguggagcccgagguggccaaccuggacaucaucggccagcgcaucgagaacaucaagaacgagcacaagagcacguggcacuacgacgaggacaaccccuacaagaccugggccuaccacggguccuacgaggucaagccgagcggcuccgcgagcagcauggugaacggggucgugcggcuccugaccaagcccugggacgugauccccauggucacccagaucgccaugacggacaccacccccuucggccagcagcgcguguucaaggagaagguggacacccggacgccgaaggccaagcgcggcaccgcccagaucauggaggucaccgcccgguggcuguggggguuccucucccgcaacaagaagccccggaucugcacccgcgaggaguucacgcggaaggugcgcagcaacgcggccaucggcgccguguucgucgacgagaaccaguggaacuccgccaaggaggcgguggaggacgagcgguucugggaccuggugcaccgcgagcgggagcugcacaagcaggggaagugcgcgaccugcgucuacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccgggguggagggcgaggggcugcacaagcucggcuacauccugcgcgacaucagcaagauccccggcgggaacauguacgccgacgacaccgccggcugggacacccggaucacggaggacgaccugcagaacgaggccaagaucaccgacaucauggagccggagcacgcccuccuggcgaccuccaucuucaagcugaccuaccagaacaaggugguccgcgugcagcggcccgccaagaacgggacggugauggacgucaucagccgccgcgaccagcggggcuccggccagguggggaccuacggccucaacaccuucaccaacauggaggcccagcugauccgccagauggagagcgaggggaucuuccugcccuccgagcucgagacgcccaaccuggccgagcgggugcuggacuggcucgagaagcacggcaccgagcgccugaagcggauggccaucagcggggacgacugcgucgugaagccgaucgacgaccgcuucgcgaccgcccugaccgcccucaacgacaugggcaaggugcggaaggacaucccccagugggagcccuccaagggcuggaacgacuggcagcagguccccuucugcagccaccacuuccaccagcugaucaugaaggacgggcgcgagaucguggugccgugccggaaccaggacgagcuggucggccgcgcccgggugucccagggggccggcuggagccuccgcgagacggcgugccugggcaagagcuacgcccagauguggcagcugauguacuuccaccggcgcgaccuccggcuggccgccaacgcgaucugcuccgccgugcccgucgacugggugcccaccagccgcaccaccugguccauccacgcccaccaccaguggaugaccacggaggacaugcugagcguguggaaccgggucuggaucgaggagaaccccuggauggaggacaagacccacguguccagcugggaggacgugccguaccucggcaagcgcgaggaccaguggugcggcucccugaucgggcugaccgcccgggccaccugggcgacgaacauccaggucgccaucaaccaggugcgccgccucaucggcaacgagaacuaccuggacuacaugaccagcaugaagcgguucaagaacgaguccgaccccgagggggcccugugguga

SEQ ID NO: 7919 - RNA, 9879 nt, Artificial Sequence
  derived and/or modified CDS sequence (opt1) from DENV-1__LC011945__SS-prME
agcgugaccaugcugcucaugcugaugcccaccgcccuggccuuccaccucaccacccggggcggggagccccacaugaucguguccaagcaggagcggggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuaccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccaucgcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcggaagcugcgcacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacggguccgagcgggucauccucgccggccccaugcccgugacggucgccagcgccgcgcagcgccgggggcgcaucggccggaaccacaacaaggagggcgaccaguacaucuacauggggcagccgcugaacaacgacgaggaccacgcccacuggaccgaggccaagaugcugcucgacaacaucaacacccccgagggcaucauccccgcccuguucgagcccgagcgcgagaaguccgccgcgaucgacggggaguaccgccugcggggcgaggcccgcaagaccuucguggagcucaugcggcgcggggaccugccgguguggcugagcuacaaggucgccagcgagggcuuccaguacuccgaccggcgcuggugcuucgacggcgagcggaacaaccaggugcucgaggagaacauggacguggagaucuggacgaaggagggggagcgcaagaagcugcggccccgcuggcuggacgcccggaccuacagcgacccccucgcccugcgcgaguucaaggaguucgcggccggccggcgcuccgucagcggggaccugauccucgagaucggcaagcugccccagcaccugacccagcgggcccagaacgcccucgacaaccuggugaugcugcacaacuccgagcagggcgggcgcgcguaccggcacgccauggaggagcucccggacaccaucgagacgcugaugcugcucgcccugaucgccgugcugaccggcggggucacccucuucuuccugagcggcaaggggcugggcaagaccuccaucggccuccugugcgugauggccagcuccgugcugcucuggauggcgagcgucgagccccacuggaucgccgccuccaucauccuggaguucuuccugauggugcuccugauccccgagcccgaccgccagcggaccccgcaggacaaccagcuggccuacguggucaucgggcuccuguucaugauccugacgguggccgcgaacgagaugggccuccuggagaccaccaagaaggaccuggggaucggccacguggccgucgagaaccaccaccacgccgccaugcucgacguggaccugcaccccgccagcgcguggacccuguacgccguggccacgaccaucaucacccccaugaugcgccacaccaucgagaacacgaccgccaacaucucccucaccgccaucgcgaaccaggccgccauccugauggggcuggacaagggcuggccgaucagcaagauggacaucggcgucccccuccuggcccuggggugcuacucccaggugaacccccucacccugacggcggccgugcugaugcucgucgcccacuacgccaucaucggccccgggcugcaggccaaggcgacccgggaggcccagaagcgcaccgccgccggcaucaugaagaacccgaccguggacgggaucguggccaucgaccuggaccccgucguguacgacgcgaaguucgagaagcagcucggccagaucaugcugcugauccucugcacgagccagauccugcugaugcgcaccaccugggcccucugcgaguccaucacccuggccacgggcccccugaccacccucugggaggggagccccggcaaguucuggaacaccacgaucgccguguccauggccaacaucuuccgggggagcuaccuggcgggcgccggccuggccuucagccucaugaagucccucgggggcgggcgccgggggaccggggcccagggcgagacccugggcgagaaguggaagcgccagcucaaccagcugagcaaguccgaguucaacaccuacaagcggagcgggaucauggaggucgaccgcuccgaggcgaaggagggccugaagcgcggggagacgaccaagcacgccgugagccgcggcaccgccaagcuccggugguucguggagcgcaaccuggucaagccggaggggaaggugaucgaccugggcugcggccgcggcgggugguccuacuacugcgccgggcugaagaaggugaccgaggucaagggguacacgaagggcggccccggccacgaggagcccgugcccauggccaccuacggguggaaccucgugaagcugcacagcggcaaggacgucuucuucaucccgcccgagaagugcgacacccugcucugcgacaucggggaguccagccccaaccccaccaucgaggagggccgcacgcugcgggugcugaagaugguggagccguggcuccgcgggaaccaguucugcaucaagauccugaaccccuacaugcccuccgucguggagacccuggagcagaugcagcggaagcacggcggcaugcucgugcgcaacccccugagccggaacuccacccacgagauguacugggucagcugcgggaccggcaacaucguguccgcgaucaacaugaccagccgcaugcugcucaaccgguucacgauggcccaccgcaagccgaccuacgagcgcgacguggaccugggggccggcacccggcacgucgccguggagcccgagguggccaaccuggacaucaucggccagcgcaucgagaacaucaagugcgagcacaaguccaccuggcacuacgacgaggacaaccccuacaagacgugggcguaccacgggagcuacgaggucaagcccuccggcagcgccagcuccauggugaacggggucgugaagcuccugaccaagccgugggacgugauccccauggucacccagaucgccaugaccgacacgacccccuucggccagcagcggguguucaaggagaagguggacacccgcacccccaaggccaagcgggggacggcccagaucauggaggucaccgcgcgcuggcuguggggcuuccucagccggaacaagaagccgcgcaucugcacccgggaggaguucacccgcaaggugcgguccaacgccgccaucggcgccguguucgucgacgagaaccaguggaacagcgcgaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagaucagcgggggcaacauguacgccgacgacaccgccggcugggacacccgcaucaccgaggacgaccugcagaacgaggccaagaucacggagaucauggagcccgagcacgcgcagcucgccaaggccaucuucaagcugaccuaccagaacaaggugguccgggugcagcgccccgccaagaacgggaccgugauggacgucaucucccgccgggaccagcgcggcagcggccagguggggaccuacggccugaacacguucaccaacauggaggcccagcucauccggcagauggaguccgaggggaucuucagcccguccgagcuggagacccccaaccuggcggagcgcgugcucgacuggcuggagaaguacggcgucgagcggcugaagcgcauggccaucagcggggacgacugcguggugaagcccaucgacgaccgguucgccaccgcccucacggcccugaacgacaugggcaagguccgcaaggacaucccccagugggagccguccaagggguggaacgacuggcagcagguccccuucugcagccaccacuuccaccagcugaucaugaaggacggccgggagaucgugguccccugccgcaaccaggacgagcucgugggccgggcgcgcgugagccagggggccggcuggucccugcgggagaccgccugccugggcaagagcuacgcccagauguggcagcucauguacuuccaccgccgggaccugcgccuggcggccaacgccaucugcuccgccguccccguggacugggugccgaccagccggaccacgugguccauccacgcccaccaccaguggaugaccaccgaggacaugcucagcgucuggaaccgcguguggaucgaggagaaccccuggaugaaggacaagacccacaucuccagcugggaggacgugcccuaccugggcaagcgggaggaccaguggugcgggucccugaucggccucacggcgcgcgccaccugggccaccaacauccaggucgccaucaaccaggugcgccggcugaucggcaacgagaacuaccuggacuacaugaccagcaugaagcgcuucaagaacgaguccgaccccgagggggcccucugguga

SEQ ID NO: 7920 - RNA, 9879 nt, Artificial Sequence
  derived and/or modified CDS sequence (opt1) from DENV-1__LC011949__SS-prME
agcgugaccaugcugcugaugcuggugcccaccgcccuggccuuccaccucaccacccggggcggggagccccacaugaucgugagcaagcaggagcggggcaagagccugcuguucaagaccuccgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccguggcccucgcgccccacgucggccuggggcuggagacgcggaccgagaccuggaugagcuccgagggcgccuggaagcagauccagcggguggagaccugggcccuccggcaccccggguucacggugaucgcccuguuccuggcgcacgccaucggcaccagcaucacccagaaggggaucaucuucauccuccugaugcuggucacccccuccauggccaugcggugcgugggcaucggcagccgcgacuucguggaggggcucuccggcgccacgugggucgacguggugcuggagcacgggagcugcgucaccaccauggccaaggacaagcccacccuggacaucgagcuccugaagacggaggugaccaaccccgcggugcugcggaagcucugcaucgaggccaagaucuccaacaccaccacggacagccgcugcccgacccagggcgaggccacccuggucgaggagcaggacgccaacuucgugugccggcgcaccuucguggaccggggcugggggaacggcugcgggcuguucggcaaggggucccucaucacgugcgccaaguucaagugcgucaccaagcuggagggcaagaucgugcaguacgagaaccugaaguacagcgugaucgucaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucgugcacaagcagugguuccuggaccugccccuccccuggaccagcggggccagcaccucccaggagacguggaaccggcaggaccugcuggucaccuucaagaccgcccacgcgaagaagcaggagguggugguccucggcagccaggagggcgccaugcacaccgcccugacgggggccaccgagauccagaccuccggcaccacgaccaucuucgccgggcaccugaagugccgccucaagauggacaagcugacccugaagggcaccagcuacgugaugugcacgggguccuucaagcucgagaaggagguggcggagacccagcacggcaccguccuggugcagaucaaguacgagggcaccgacgcccccugcaagauccccuucagcacgcaggacgagaagggggugacccagaacggccggcugaucaccgccaacccgaucgucaccgacaaggagaagcccgugaacaucgaggccgagccgcccuucggggaguccuacaucgugaucggcgcgggcgagaaggcccugaagcucagcugguucaagaagggguccagcaucggcaagauguucgaggccacggcccgcggggcccggcgcauggcgauccugggcgacaccgccugggacuucggguccaucggcggcgucuucaccagcguggggaagcuggugcaccagaucuucggcaccgccuacgggguccucuucuccggcgugagcuggacgaugaagaucgggaucggcgugcugcugaccuggcucggccugaacucccgcagcaccucccugagcaugaccugcaucgccgucgggcucgugacgcuguaccugggcgugaugguccaggccgacaccgggugcgugaucaacuggaagggccgggagcucaagugcggguccggcaucuucgugaccaacgagguccacaccuggaccgagcaguacaaguuccaggcggacagcccgaagcgccugagcgccgccaucggcaaggccugggaggagggggugugcggcauccgguccgccacgcgccuggagaacaucauguggaagcagaucagcaacgagcucaaccacauccugcuggagaacgacaugaaguucaccguggucgugggggacguggcgggcauccucgcccaggggaagaagaugauccggccccagcccauggaguacaaguacuccuggaaguccuggggcaaggccaagaucaucggcgccgacguccagaacaccaccuucaucaucgacgggcccaacacgccggagugccccgacgaccagcgcgcguggaacaucugggagguggaggacuacggcuucgggaucuucaccaccaacaucuggcugaagcugcgggacuccuacacccaggugugcgaccaccgccucaugagcgccgccaucaaggacuccaaggccguccacgccgacaugggcuacuggaucgagagcgagaagaacgagacguggaagcuggcgcgggccuccuucaucgaggugaagaccugcaucuggcccaagagccacacccugugguccaacggcgugcucgagagcgagaugaucauccccaagaucuacgggggcccgaucucccagcacaacuaccgccccggguacuucacccagacggccggccccuggcaccuggggaagcuggagcucgacuucgaccugugcgagggcaccaccgucgugguggacgagcacugcggcaaccgggggccgagccugcgcaccacgaccgucaccggcaagaucauccacgaguggugcugccgguccugcacccugccgccccuccgcuuccgcggggaggacggcugcugguacgggauggagauccgccccgugaaggagaaggaggagaaccuggucaagagcauggucuccgccggcagcggcgagguggacagcuucucccucgggcugcugugcaucagcaucaugaucgaggaggugaugcggucccgcuggagccggaagaugcucaugacgggcacccuggccgucuucuuccugcucaucauggggcagcugaccuggaacgaccugauccgccucugcaucauggugggcgcgaacgccuccgaccgcauggggaugggcaccacguaccuggcccugauggccaccuucaagaugcggccgauguucgccgugggccuccuguuccgccggcugaccagccgcgagguccuccugcugaccaucgggcucucccugguggcgagcgucgagcugcccaacucccucgaggagcugggcgacgggcuggccaugggcaucaugauccucaagcugcugacggacuuccagagccaccagcucugggccacccugcugucccucaccuucaucaagaccacguucagccugcacuacgccuggaagaccauggcgauggugcuguccaucgugagccucuucccccugugccuguccaccaccagccagaagacgaccuggcuccccguccugcugggcucccucgggugcaagccgcugaccauguuccugaucgccgagaacaagaucuggggccgcaagagcuggccccucaacgaggggaucauggccgugggcaucguguccauccugcugagcagccuccugaagaacgacgucccccuggccgggccccucaucgccggcggcaugcugaucgcgugcuacgugaucuccgggagcuccgccgaccugagccucgagaaggccgccgagguguccugggaggaggaggccgagcacagcggcgcgucccacaacauccuggucgaggugcaggacgacgggaccaugaagaucaaggacgaggagcgcgacgacacccugacgauccuccugaaggccacccugcucgccgugagcggcgucuacccgcuguccauccccgccacccuguucgugugguacuucuggcagaagaagaagcagcggagcggggugcucugggacacccccagcccgcccgaggucgagcgcgccgugcuggacgacggcaucuaccggaucaugcagcgcggccugcuggggcggagccaggugggcgucgggguguuccaggagaacguguuccacacgauguggcacgucacccgcggcgcggugcucauguaccaggggaagcggcuggagcccuccugggccagcgugaagaaggaccugaucuccuacggcggcggguggcgccuccagggcagcuggaacaccggggaggagguccaggugaucgccguggagcccggcaagaaccccaagaacguccagaccgcccccgggacguucaagacccccgagggcgaggugggcgccaucgcgcuggacuucaagcccgggaccuccggcagccccaucgugaaccgggaggggaagaucgucggccuguacggcaacgggguggugaccacguccggcaccuacgucagcgccaucgcccaggccaaggcgagccaggaggggccgcuccccgagaucgaggacgagguguucaagaagcgcaaccugaccaucauggaccugcaccccggcuccgggaagacccggcgcuaccucccggccaucgugcgggaggccaucaagcgcaagcugcggacgcugauccucgcccccacccgcgucguggccagcgagauggcggaggcccugaagggcaugcccauccgcuaccagaccaccgccgugaaguccgagcacacgggcaaggagaucgucgaccugaugugccacgccaccuucaccaugcggcuccugagccccgugcgcgugccgaacuacaacaugaucaucauggacgaggcccacuucaccgaccccuccagcaucgcggcccggggguacaucuccacgcgcgucggcaugggggaggccgccgccaucuucaugaccgcgacgccgcccggcagcguggaggccuucccgcaguccaacgccgugauccaggacgaggagcgggacauccccgagcgcagcuggaacuccggguacgaguggaucaccgacuuccccggcaagacggucugguucgugcccagcaucaaguccggcaacgacaucgccaacugccugcggaagaacgggaagcgcgugauccagcucagccggaagaccuucgacaccgaguaccagaagaccaagaacaacgacugggacuacgucgugacgaccgacaucuccgagaugggcgcgaacuuccgcgccgaccgggugaucgacccgcgccggugccugaagcccgucauccugaaggacgggcccgagcgcgugauccucgccggccccaugccggucaccguggccagcgccgcgcagcggcgcgggcggaucggccgcaaccacaacaaggagggcgaccaguacaucuacauggggcagccccugaacaacgacgaggaccacgcccacuggaccgaggccaagaugcugcucgacaacaucaacacgcccgagggcaucauccccgcccuguucgagccggagcgggagaaguccgccgcgaucgacggggaguaccgccugcgcggcgaggcccggaagaccuucguggagcucaugcgccgcggggaccugcccgucuggcugagcuacaagguggccuccgagggcuuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacagcgacccccucgcccugcgggaguucaaggaguucgcggccggccgccgguccaucagcggggaccugauccucgagaucggcaagcugccgcagcaccugacgcagcgcgcccagaacgcccucgacaaccuggugaugcugcacaacuccgagcagggcgggcgggcguaccgccacgccauggaggagcuccccgacaccaucgagacccugaugcugcucgcccugaucgccgugcugaccggcggggucacccucuucuuccugagcggccgggggcugggcaagacguccaucggccuccugugcgugauggccagcuccgugcugcucuggauggcgagcgucgagccccacuggaucgccgccuccaucauccuggaguucuuccugauggugcuccugauccccgagccggaccgccagcggacgccccaggacaaccagcuggccuacguggucaucgggcuccuguucaugauccugaccguggccgcgaacgagaugggccuccuggagaccacgaagaaggaccuggggaucggccacguggccgucgagaaccaccaccacgccgccaugcucgacguggaccugcaccccgccagcgcguggacccuguacgccguggccaccaccaucaucacgccgaugaugcgccacaccaucgagaacaccaccgccaacaucucccucacggccaucgcgaaccaggccgccauccugauggggcuggacaagggcuggcccaucagcaagauggacaucggcgucccccuccuggcccuggggugcuacucccaggugaacccccucacccugaccgcggccgugcugaugcucgucgcccacuacgccaucaucggcccggggcugcaggccaaggcgacccgggaggcccagaagcgcacggccgccggcaucaugaagaaccccaccguggacgggaucguggccaucgaccuggaccccgucguguacgacgcgaaguucgagaagcagcucggccagaucaugcugcugauccucugcaccagccagauccugcugaugcgcaccacgugggcccucugcgaguccaucacccuggccaccggcccccugaccacgcucugggaggggagcccgggcaaguucuggaacaccaccaucgccguguccauggccaacaucuuccgggggagcuaccuggcgggcgccggccuggccuucucccucaugaagucccucgggggcgggcgccgggggaccggggcccagggcgagacgcugggcgagaaguggaagcgccagcucaaccagcugagcaaguccgaguucaacaccuacaagcggagcgggaucauggaggucgaccgcuccgaggcgaaggagggccugaagcgcggggagaccaccaagcacgccgugagccgcggcacggccaagcuccggugguucguggagcgcaaccuggucaagcccgaggggaaggugaucgaccugggcugcggccgcgggggcugguccuacuacugcgccgggcugaagaaggugaccgaggucaagggcuacaccaagggcggccccggccacgaggagcccaucccgauggccaccuacggguggaaccucgugaagcugcacagcggcaaggacguguucuucaucccgcccgagaagugcgacacgcugcucugcgacaucggggaguccagccccaacccgaccaucgaggagggccgcacccugcggguccugaagaugguggagcccuggcuccgcgggaaccaguucugcaucaagauccugaaccccuacaugcccuccguggucgagacccuggagcagaugcagcggaagcacggcggcaugcucgugcgcaacccgcugagccggaacuccacccacgagauguacugggugagcugcgggacgggcaacaucgucuccgcggugaacaugaccagccgcaugcugcucaaccgguucaccauggcccaccgcaagcccaccuacgagcgcgacguggaccugggggccggcacgcggcacgucgccguggagcccgagguggccaaccuggacaucaucggccagcgcaucgagaacaucaagcacgagcacaaguccaccuggcacuacgacgaggacaaccccuacaagaccugggcguaccacgggagcuacgaggucaagccguccggcagcgccuccagcauggugaacggggucgugaagcuccugaccaagcccugggacgugauccccauggucacgcagaucgccaugaccgacaccacccccuucggccagcagcggguguucaaggagaagguggacacgcgcaccccgaaggccaagcgggggaccgcccagaucauggaggucaccgcgcgcuggcuguggggcuuccucagccggaacaagaagccccgcaucugcacgcgggaggaguucacccgcaaggugcgguccaacgccgccaucggcgccguguucgucgacgagaaccaguggaacagcgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagauccccgggggcaacauguacgccgacgacaccgccggcugggacacgcgcaucaccgaggacgaccugcagaacgaggccaagaucaccgacaucauggagccggagcacgcgcuccuggccaaggccaucuucaagcugaccuaccagaacaaggugguccgggugcagcgccccgccaagaacgggacggugauggacgucaucagccgccgggaccagcgcggcuccggccagguggggaccuacggccucaacaccuucaccaacauggaggcccagcugauccggcagauggagagcgaggggaucuuccugcccuccgagcucgagacgcccaaccuggcggagcgcgugcuggacuggcucgagaaguacggcgucgagcggcugaagcgcauggccaucagcggggacgacugcguggugaagccgaucgacgaccgguucgccaccgcccugaccgcccucaacgacaugggcaagguccgcaaggacaucccccagugggagcccuccaagggguggaacgacuggcagcagguccccuucugcagccaccacuuccaccagcugaucaugaaggacggccgggagaucguggucccgugccgcaaccaggacgagcuggugggccgggcgcgcgugucccagggggccggcuggagccuccgggagaccgccugccuggggaaguccuacgcccagauguggcagcugauguacuuccaccgccgggaccuccgccuggcggccaacgccaucugcagcgccguccccguggacugggugcccacgagccggaccaccugguccauccacgcccaccaccaguggaugaccacggaggacaugcugagcgucuggaaccgcguguggaucgaggagaaccccuggauggaggacaagacccacaucuccagcugggaggacgugccguaccucggcaagcgggaggaccaguggugcgggucccugaucggccugaccgcgcgcgccaccugggccaccaacauccaggucgccaucaaccaggugcgccggcucaucggcaacgagaacuaccuggacuacaugacgagcaugaagcgcuucaagaacgaguccgaccccgagggggcccugugguga

SEQ ID NO: 7921 - RNA, 9879 nt, Artificial Sequence
  derived and/or modified CDS sequence (opt1) from DENV-1__HM469966__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaugacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcggaagcugcgcacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgacuggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucgugcucgccggccccaugccggucacgguggccuccgccgcgcagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccgucuggcuguccuacaagguggccagcgagggcuuccaguacagcgaccggcgcuggugcuucgacggcgagcggaacaaccaggugcucgaggagaacauggacgucgagaucuggacgaaggagggggagcgcaagaagcugcggccccgcuggcuggacgcccggaccuacuccgacccccucgcccugcgcgaguucaaggaguucgcggccggccggcgcagcguguccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccguccugaccggcggggugacccucuucuuccuguccggccgcgggcugggcaagaccagcaucggccuccugugcgugauggccuccagcguccugcucuggaucgcguccguggagccccacuggaucgccgccagcaucauccuggaguucuuccugauggugcuccugauccccgagccggaccggcagcgcacgccccaggacaaccagcuggccuacgucgugaucgggcuccuguucaugauccugacgguggccgcgaacgagaugggccuccuggagaccaccaagaaggaccuggggaucggccacgucgccguggagaaccaccaccacgccgccauccucgacguggaccugcaccccgccuccgcguggacccuguacgccgucgccacgaccaucaucaccccgaugaugcggcacaccaucgagaacacgaccgccaacaucagccucaccgccaucgcgaaccaggccgccauccugauggggcuggacaagggcuggcccaucuccaagauggacaucggcgugccccuccuggcccuggggugcuacagccaggugaacccccucacccugacggcggccguccugaugcucguggcccacuacgccaucaucggcccggggcugcaggccaaggcgacccgcgaggcccagaagcgcaccgccgccggcaucaugaagaaccccaccguggacgggaucgucgccaucgaccuggaccccgugguguacgacgcgaaguucgagaagcagcucggccagaucaugcugcugauccucugcacgucccagauccugcugaugcggaccaccugggcccucugcgagagcaucacccuggccacgggcccccugaccacccucuggaagggguccccgggcaaguucuggaacaccacgaucgccgucagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcuguccaagagcgaguucaacaccuacaagcgcuccgggaucauggagguggaccggagcgaggcgaaggagggccugaagcgcggggagacgaccaagcacgccgugucccggggcaccgccaagcuccgcugguucgucgagcggaaccuggugaagcccgaggggaaggugaucgaccugggcugcggccgcgggggcuggagcuacuacugcgccgggcugaagaaggucaccgaggugaagggcuacacgaagggcgggcccggccacgaggagcccaucccgauggccaccuacggguggaaccucgugaagcuguacuccggcaaggacgucuucuucaucccgcccgagaagugcgacacccugcucugcgacaucggggagagcucccccaacccgaccaucgaggagggccggacgcugcgcgugcugaagaugguggagcccuggcuccgggggaaccaguucugcaucaagauccugaaccccuacaugcccagcgucguggagacccuggagcagaugcagcgcaagcacggcggcaugcucgugcggaacccgcugucccgcaacagcacccacgagauguacugggucuccugcgggaccggcaacaucgugagcgcggugaacaugaccucccggaugcugcucaaccgcuucacgauggcccaccgcaagcccaccuacgagcgggacgucgaccugggggccggcacccgccacguggccguggagcccgaggucgccaaccuggacaucaucggccagcggaucgagaacaucaagcacgagcacaagagcaccuggcacuacgacgaggacaaccccuacaagacgugggcguaccacggguccuacgaggugaagccgagcggcuccgccagcagcauggucaacgggguggugaagcuccugaccaagcccugggacgucauccccauggugacccagaucgccaugaccgacacgacccccuucggccagcagcgcguguucaaggagaaggucgacacccggaccccgaaggccaagcgcgggacggcccagaucauggaggugaccgcgcgguggcuguggggcuuccucucccgcaacaagaagccccggaucugcacccgcgaggaguucacccggaaggugcgcagcaacgccgccaucggcgccgucuucguggacgagaaccaguggaacuccgcgaaggaggccguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucucccgggagaacagccuguccgggguggagggcgaggggcugcacaagcucggcuacauccugcgcgacaucagcaagauccccgggggcaacauguacgccgacgacaccgccggcugggacacccggaucaccgaggacgaccugcagaacgaggccaagaucacggacaucauggagccggagcacgcgcuccuggccaaggccaucuucaagcugaccuaccagaacaaggucgugcgcgugcagcgccccgccaagaacgggaccgucauggacgugaucucccggcgcgaccagcggggcagcggccagguggggaccuacggccucaacacguucaccaacauggaggcccagcugauccgccagauggaguccgaggggaucuucagccccuccgagcuggagacccccaaccucgcggagcggguccuggacuggcuggagaaguacggcguggagcgccucaagcggauggccaucagcggggacgacugcguggucaagccgaucgacgaccgcuucgccaccgcccugacggcccugaacgacaugggcaaggugcggaaggacaucccccagugggagcccuccaagggguggaacgacuggcagcagguccccuucugcagccaccacuuccaccagcucaucaugaaggacggccgcgagaucgucgugccgugccggaaccaggacgagcuggugggccgcgcgcgggucucccagggggccggcuggagccugcgcgagaccgccugccucggcaagagcuacgcccagauguggcagcugauguacuuccaccggcgcgaccugcggcucgcggccaacgccaucugcuccgccgugcccguggacuggguccccaccagccgcaccacgugguccauccacgcccaccaccaguggaugaccaccgaggacaugcugagcguguggaaccggguguggaucgaggagaaccccuggauggaggacaagacccacaucuccagcugggaggacgucccguaccugggcaagcgcgaggaccaguggugcgggucccucaucggccugacggcgcgcgccaccugggccaccaacauccagguggccaucaaccaggugcggcgccugaucggcaacgagaacuaccucgacuacaugaccagcaugaagcgguucaagaacgaguccgaccccgagggggcccugugguga

SEQ ID NO: 7922 - RNA, 9879 nt, Artificial Sequence
  derived and/or modified CDS sequence (opt1) from DENV-1__JX669462__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgagaagcgguccguggcccuggcgccccacgugggccuggggcucgagacccgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacgcucgccgucuuccugcugcucaucaugggccagcugaccuggaacgaccugauccgccucugcaucauggugggggccaacgcguccgaccggaugggcaugggcaccaccuaccuggcccugauggccacgcucaagaugcgcccgauguucgccguggggcugcuguuccggcgccucaccagccgggagguccugcugcucaccaucggccugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgcgacgcuguucgugugguacuucuggcagaagaagaagcagcgcuccggcgugcucugggacacccccagcccgcccgaggucgagcgggccgugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccuccccgagaucgaggacgagguguucaagaagcggaaccugaccaucauggaccugcacccgggcagcggcaagacccgccgguaccuccccgccaucgugcgcgaggccaucaagcgcaagcugcggacccugauccucgcccccacgcgcgucguggcguccgagauggccgaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcucagccggaagacguucgacaccgaguaccagaagaccaagaacaacgacugggacuacgucgugaccacggacaucuccgagaugggcgccaacuuccgcgccgaccgggugaucgacccccgccggugccugaagcccgucauccugaaggacgggcccgagcgcgugauccucgccggcccgaugcccgucaccguggcgagcgccgcccagcggcgcggccgcaucgggcggaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucgucgagcucaugcgccggggcgaccugcccguguggcugagcuacaagguggccuccgagggguuccaguacagcgaccgccgguggugcuucgacggcgagcgcaacaaccagguccucgaggagaacauggacguggagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggucaugcuccacaacuccgagcagggcgggaaggccuaccggcacgccauggaggagcugcccgacaccaucgagacgcugaugcuccuggcccugaucgcggugcucaccggcggggugacccuguucuuccugagcggcaagggccucgggaagaccuccaucggccugcugugcgucacggccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccacgaagaaggaccucgggaucggcuacgucgccgcggagaaccaccagcacgccaccaugcuggacguggaccugcacccggccagcgccuggacccucuacgccguggcgaccacggucaucacccccaugaugcgccacaccaucgagaacaccacggccaacaucucccugaccgccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacgcgcgaggcccagaagcggaccgcggccggcaucaugaagaaccccaccguggacggcaucgucgccaucgaccucgaccccgugguguacgacgccaaguucgagaagcagcuggggcagaucaugcugcucauccugugcaccagccagauccugcucaugcgcacgaccugggcccugugcgaguccaucacccuggcgaccggcccgcucacgacccugugggaggggagccccggcaaguucuggaacaccaccaucgccgucuccauggccaacaucuuccggggcagcuaccuggccggggccggccucgcguucucccugaugaagucccucgggggcgggcgccgggggacgggcgcccagggggagacccucggcgagaaguggaagcgccagcugaaccagcuguccaagagcgaguucaacaccuacaagcggagcgggaucauggagguggaccgcuccgaggccaaggagggccucaagcgcggggagaccacgaagcacgccgugagccgcggcaccgcgaagcugcggugguucgucgagcgcaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacgcuccugugcgacaucggggaguccagcccgaaccccaccaucgaggagggccgcacccugcgggugcucaagaugguggagcccuggcugcgcggcaaccaguucugcaucaagauccugaaccccuacaugccguccgucguggagacccucgagcagaugcagcggaagcacgggggcaugcuggugcgcaacccccugagccggaacuccacgcacgagauguacugggucagcugcgggaccggcaacaucguguccgccgugaacaugaccagccgcaugcuccugaaccgcuucaccauggcccaccggaagcccacguacgagcgcgacgucgaccugggcgcggggacccggcacguggccguggagcccgaggucgccaaccucgacaucaucggccagcgcaucgagaacaucaagaacgagcacaaguccaccuggcacuacgacgaggacaacccguacaagaccugggccuaccacgggagcuacgaggugaagcccuccggcagcgccuccagcauggucaacgggguggugcggcugcugacgaagcccugggacgucauccccauggugacccagaucgcgaugaccgacaccacgccguucggccagcagcgcguguucaaggagaaggucgacacccggacgccccgggccaagcggggcaccacgcagaucauggaggugaccgccaaguggcucuggggguuccugucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcuccacaagcaggggaagugcgccacgugcguguacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggucgugcgggugcagcgccccgccaagaacgggaccgucauggacgugaucucccggcgcgaccagcggggcagcggccagguggggacguacggccugaacaccuucaccaacauggagguccagcugauccgccagauggaguccgaggggaucuuccuccccagcgagcuggagaccccgaaccuggcggagcgggcccucgacuggcuggagaagcacggcgccgagcgccugaagcggauggccaucuccggggacgacugcguggugaagcccaucgacgaccgcuucgccacggcgcucaccgcccugaacgacaugggcaagguccggaaggacaucccccagugggagcccagcaagggcuggaacgacuggcagcaggucccguucugcucccaccacuuccaccagcugaucaugaaggacgggcgcgagaucgugguccccugccggaaccaggacgagcucgugggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcgguccccguggacugggugcccgccagccgcaccaccuggagcauccacgcccaccaccaguggaugacgaccgaggacaugcucuccgucuggaaccgcguguggaucgaggagaacccguggauggaggacaagacccacgugagcuccugggaggagguccccuaccugggcaagcgggaggaccaguggugcggcagccugaucgggcucaccgcccgcgccacgugggcgaccaacauccagguggccaucaaccaggugcggcgccugaucggcaacgagaacuaccuggacuacaugaccuccaugaagcgguucaagaacgagagcgaccccgagggggcccucugguga

SEQ ID NO: 7923 - RNA, 9879 nt, Artificial Sequence
  derived and/or modified CDS sequence (opt1) from DENV-1__JX669463__SS-prME
agcgugaccaugcugcucaugcugcugcccaccgcccucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccugaucacggccaacccgaucgucaccgacaaggagaagcccgugaacaucgagaccgagccgcccuucggggagagcuacaucguggucggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcguguucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggucaagaccugcacguggcccaagagccacacccugugguccaacggggugcucgagagcgagaugaucauccccaagaucuucggcgggccgaucucccagcacaacuaccgccccggcuacuucacccagaccgccgggcccuggcaccugggcaagcuggagcucgacuucgaccugugcgagggcacgaccguggucguggacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgucaaggagaaggaggagaaccuggugcggagcaugguguccgccggcagcggggaggucgacagcuucucccucggcauccugugcgugagcaucaugaucgaggaggugaugcgcucccgcuggagccggaagaugcugaugaccgggacgcucgccgucuuccugcugcucaucaugggccagcugaccuggaacgaccugauccgccucugcaucauggugggggccaacgcguccgaccggaugggcaugggcaccaccuaccuggcccugauggccacgcucaagaugcgcccgauguucgccguggggcugcuguuccggcgccucaccagccgggagguccugcugcucaccaucggccugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccauggugcugagcaucgucucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgucccccucgcgggcccgcugaucgccggcgggaugcugaucgccugcuacgugaucagcggcuccagcgccgaccucucccuggagaaggccgcggaggugagcugggagcaggaggccgagcacuccggggccagccacaacauccuggucgaggugcaggacgacggcacgaugaagaucaaggacgaggagcgggacgacacccucaccauccugcugaaggccacccuccuggccguguccggggucuaccccaugagcauccccgcgacgcuguucgugugguacuucuggcagaagaagaagcagcgcuccggcgugcucugggacacccccagcccgcccgaggucgagcgggccgugcuggacgacggcaucuaccgcauccugcagcgggggcugcucggccgcucccaggugggggucggcguguuccaggacgggguguuccacaccauguggcacgucacccggggcgccgugcugauguaccagggcaagcgccuggagcccagcugggccuccgugaagaaggaccucaucagcuacgggggcggguggcgguuccagggcuccuggaacacgggggaggagguccaggugaucgccguggagcccggcaagaacccgaagaacguccagaccacccccggcaccuucaagacgcccgagggggaggugggcgcgaucgcccuggacuucaagcccgggaccagcggcuccccgaucgugaaccgcgagggcaagaucgucgggcuguacggcaacgggguggugaccaccagcggcacguacgucuccgccaucgcccaggccaaggcgagccaggaggggccccuccccgagaucgaggacgagguguucaagaagcggaaccugaccaucauggaccugcacccgggcagcggcaagacccgccgguaccuccccgccaucgugcgcgaggccaucaagcgcaagcugcggacccugauccucgcccccacgcgcgucguggcguccgagauggccgaggcccugaaggggaugcccauccgguaccagaccaccgccgucaagagcgagcacaccggccgcgagaucgucgaccugaugugccacgccacguucaccaugcggcuccuguccccggugcgcgugcccaacuacaacaugaucaucauggacgaggcgcacuucaccgaccccgccagcaucgccgcccggggguacaucuccacccgcgucggcaugggggaggccgcggccaucuucaugacggccacgccgcccggcagcguggaggccuucccccaguccaacgccgugauccaggacgaggagcgggacauccccgagcgcagcuggaacuccggcuacgacuggaucaccgacuuccccgggaagaccgucugguucgugcccagcaucaaguccggcaacgacaucgcgaacugccugcggaagaacgggaagcgcgugauccagcucagccggaagacguucgacaccgaguaccagaagaccaagaacaacgacugggacuacgucgugaccacggacaucuccgagaugggcgccaacuuccgcgccgaccgggugaucgacccccgccggugccugaagcccgucauccugaaggacgggcccgagcgcgugauccucgccggcccgaugcccgucaccguggcgagcgccgcccagcggcgcggccgcaucgggcggaaccagaacaaggagggcgaccaguacaucuacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcacccggccagcgccuggacccucuacgccguggcgaccacggugaucacccccaugaugcgccacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcggaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcgcacgaccugggcccugugcgaguccaucacccuggcgaccggcccgcucacgacccugugggaggggagccccggcaaguucuggaacaccaccaucgccguguccauggccaacaucuuccggggcagcuaccuggccggggccggccucgcguucucccugaugaagucccucgggggcgggcgccgggggacgggcgcccagggggagacccucggcgagaaguggaagcgccagcugaaccagcuguccaagagcgaguucaacaccuacaagcggagcgggaucauggaggucgaccgcuccgaggccaaggagggccucaagcgcggggagaccacgaagcacgccgugagccgcggcaccgcgaagcugcggugguucguggagcgcaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccgcacccugcggguccucaagaugguggagcccuggcugcgcggcaaccaguucugcaucaagauccugaaccccuacaugccguccguggucgagacccucgagcagaugcagcggaagcacgggggcaugcuggugcgcaacccccugagccggaacuccacgcacgagauguacugggugagcugcgggaccggcaacaucgucuccgccgugaacaugaccagccgcaugcuccugaaccgcuucaccauggcccaccggaagcccacguacgagcgcgacguggaccugggcgcggggacccggcacgucgccguggagcccgagguggccaaccucgacaucaucggccagcgcaucgagaacaucaagaacgagcacaaguccaccuggcacuacgacgaggacaacccguacaagaccugggccuaccacgggagcuacgaggucaagcccuccggcagcgccuccagcauggugaacggggucgugcggcugcugacgaagcccugggacgugauccccauggucacccagaucgcgaugaccgacaccacgccguucggccagcagcgcguguucaaggagaagguggacacccggacgccccgggccaagcggggcaccacgcagaucauggaggucaccgccaaguggcucuggggguuccugucccgcaacaagaagccccggaucugcacccgcgaggaguucacccggaaggugcgcagcaacgccgccaucggcgcgguguucgucgacgagaaccaguggaacagcgccaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggcgaagggcucccgggccaucugguacauguggcugggggcccgcuuccucgaguucgaggcccugggcuucaugaacgaggaccacugguucagccgggagaacucccugagcgggguggagggcgaggggcuccacaagcugggcuacauccugcgcgacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggugguccgggugcagcgccccgccaagaacgggaccgugauggacgucaucucccggcgcgaccagcggggcagcggccagguggggacguacggccugaacaccuucaccaacauggaggugcagcugauccgccagauggaguccgaggggaucuuccuccccagcgagcuggagaccccgaaccuggcggagcgggcccucgacuggcuggagaagcacggcgccgagcgccugaagcggauggccaucuccggggacgacugcgucgugaagcccaucgacgaccgcuucgccacggcgcucaccgcccugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcggugcccgucgacugggugcccgccagccgcaccaccuggagcauccacgcccaccaccaguggaugacgaccgaggacaugcucuccguguggaaccgcgucuggaucgaggagaacccguggauggaggacaagacccacgugagcuccugggaggaggugcccuaccugggcaagcgggaggaccaguggugcggcagccugaucgggcucaccgcccgcgccacgugggcgaccaacauccaggucgccaucaaccaggugcggcgccugaucggcaacgagaacuaccuggacuacaugaccuccaugaagcgguucaagaacgagagcgaccccgagggggcccucugguga

SEQ ID NO: 7924 - RNA, 9879 nt, Artificial Sequence
  derived and/or modified CDS sequence (opt1) from DENV-1__JX669464__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacccgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagauggugauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgagauggacagcuucagccucgggauccugugcgucuccauccugaucgaggaggugaugcggagccgcuggucccggaagaugcucaugaccggcacccuggccguguuccugcuccugaucauggggcagcugacguggaacgaccucauccgccugugcaucauggucggcgccaacgccagcgaccgcauggggaugggcaccaccuaccuggcccucauggccaccuucaagaugcggccgauguucgccguggggcugcuguuccgccggcucacgucccgcgaggugcugcugcucaccgucgggcugagccugguggccuccgucgagcuccccaacagccuggaggagcugggcgacgggcucgccaugggcaucaugaugcugaagcugcucaccgacuuccagccccaccagcuguggaccacgcugcucucccugaccuucauccggaccagccugucccucgacuacgccuggaagaccauggcgauggcccugagcaucgugucccuguucccccucugccugagcacgaccucccagaagaccaccuggcugccggugcuccugggcagcuucgggugcaagccccugacgauguuccucaucaccgagaacaagaucuggggccgcaaguccuggcccaucaacgaggggaucauggccgucggcaucgugagcauccugcuguccagccuccugaagaacgacgugccccuggccgggccgcucaucgcgggcggcaugcugaucgccugcuacgucaucagcggguccagcgccgaccugucccucgagaaggccgccgaggugagcugggaggaggaggcggagcacuccggcaccagccacaacauccugguggagguccaggacgacgggaccaugaagaucaaggacgaggagcgggacgacacccugacgauccuccugaaggccacccugcucgccguguccggcguguaccccaugagcauccccgccacccuguucgucugguacuucuggcagaagaagaagcagcgcuccggggugcugugggacacccccagcccgcccgagguggagcgggccguccuggacgacggcaucuaccgcauccuccagcggggccugcuggggcgcucccaggugggcgugggggucuuccaggacggcguguuccacacgauguggcacgugacccgcggggcgguccucauguaccagggcaagcgccuggagcccagcugggccuccgugaagaaggaccugaucagcuacggcgggggcuggcgguuccagggguccuggaacaccggcgaggaggugcaggucaucgccguggagcccgggaagaacccgaagaacgugcagaccacgcccggcaccuucaagauccccgagggcgaggucggggccaucgcccucgacuucaagcccggcaccagcggguccccgaucgugaaccgcgagggcaagaucgugggccuguacgggaacggcgucgugaccacgagcgggaccuacguguccgcgaucgcccaggccaaggccacccaggagggcccccugcccgagaucgaggacgaggucuucaagaagcggaaccucaccaucauggaccugcacccggggagcggcaagacgcgccgguaccugcccgccaucgugcgcgaggcgaucaagcggaagcuccgcacccugauccuggcccccacccgcguggucgccagcgagauggccgaggcgcucaagggcaugcccauccgguaccagaccacggccgugaaguccgagcacaccgggcgcgagaucguggaccugaugugccacgccaccuucaccaugcggcugcucagcccgguccgcgugcccaacuacaacaugaucaucauggacgaggcccacuucacggaccccgccuccaucgcggcccggggcuacaucagcacccgcguggggaugggcgaggccgccgccaucuucaugaccgcgacgccgcccggguccgucgaggccuucccccagagcaacgccgugauccaggacgaggagcgggacauccccgagcgcuccuggaacagcggcuacgacuggaucacggacuuccccggcaagaccgugugguucguccccuccaucaagagcgggaacgacaucgccaacugccugcggaagaacggcaagcgcgugauccagcugucccggaagaccuucgacaccgaguaccagaagacgaagaacaacgacugggacuacguggucaccaccgacaucagcgagaugggggccaacuuccgcgcggaccgggugaucgacccccgccggugccucaagcccgugauccugaaggagggccccgagcgcgucauccuggccgggccgaugcccgugaccgucgccuccgccgcgcagcggcgcggccggaucggccgcaaccagaacaaggagggggaccaguacaucuacaugggccagccccucaacaacgacgaggaccacgcccacuggacggaggccaagaugcugcuggacaacaucaacacccccgaggggaucaucccggcccucuucgagcccgagcgcgagaaguccgccgcgaucgacggcgaguaccggcugcgcggggaggcccggaagaccuucguggagcugaugcgccggggcgaccuccccguguggcuguccuacaaggucgccagcgagggcuuccaguacuccgaccgccgguggugcuucgacggggagcgcaacaaccaggugcuggaggagaacauggacguggagaucuggaccaaggagggcgagcggaagaagcuccgcccccgguggcuggacgcccgcacguacagcgacccgcuggcccuccgggaguucaaggaguucgcggccgggcgccgguccgucagcggcgaccugauccuggagaucggcaagcucccccagcaccugacccugcgcgcccagaacgcccucgacaaccuggugaugcugcacaacagcgagcagggcgggaaggccuaccggcacgcgauggaggagcuccccgacaccaucgagacccugaugcugcucgcccugaucgccgugcugaccgggggcgucacccucuucuuccuguccgggaagggccugggcaagaccagcaucgggcuccugugcgugauggccuccagcgcgcugcucuggauggccuccguggagccccacuggaucgccgccagcaucauccuggaguucuuccugaugguccuccugaucccggagcccgaccgccagcggacgccccaggacaaccagcuggccuacguggugaucggccuccuguucaugauccugaccgucgcggccaacgagauggggcuccuggagacgaccaagaaggaccugggcaucgggcacguggccguggagaaccaccaccacgccaccaugcucgacgucgaccugcgcccggccuccgcguggacccuguacgccguggccacgaccgugaucacccccaugaugcggcacaccaucgagaacacgaccgccaacaucagccucaccgccaucgcgaaccaggccgccauccugaugggccuggacaagggcuggcccaucuccaagauggacaucggggucccccuccuggcccugggcugcuacagccaggugaacccgcucacccugacggccgcggugcugaugcucgucgcccacuacgccaucaucgggcccggccugcaggccaaggcgacccgcgaggcccagaagcgcaccgccgccgggaucaugaagaaccccaccguggacggcaucgugacgaucgaccuggaccccgucguguacgacgccaaguucgagaagcagcucggccagaucaugcugcugauccucugcaccucccagauccugcugaugcggaccaccugggcgcucugcgagagcaucacgcuggccaccgggccgcugaccacccucugggagggcucccccgggaaguucuggaacacgaccaucgccgugagcauggccaacaucuuccgcggcuccuaccuggccggcgcggggcuggccuucagccucaugaagucccugggcgggggccggcgcgggaccggcgcccagggcgagacccugggggagaaguggaagcggcagcucaaccagcugagcaaguccgaguucaacacguacaagaaguccggcaucauggaggucgaccgcagcgaggccaaggaggggcugaagcggggcgagaccaccaagcacgccgugucccgcgggaccgcgaagcugcggugguucguggagcgcaaccucgucaagcccgagggcaaggugaucgaccugggcugcgggcggggcggguggagcuacuacugcgccggccugaagaaggugacggaggucaagggguacaccaagggcggccccgggcacgaggagccgauccccauggccaccuacggcuggaaccucgugaagcugcacuccgggaaggacguguucuucacgccgcccgagaagugcgacacccugcucugcgacaucggcgagagcuccccgaaccccacgaucgaggaggggcgcacccugcggguccugaagaugguggagcccuggcuccgcggcaaccaguucugcaucaagauccugaaccccuacaugccgagcguggucgagacccuggagcagaugcagcggaagcacggcgggaugcucgugcgcaacccccugucccggaacagcacccacgagauguacuggguguccugcggcacggggaacaucgucagcgccgugaacaugaccucccgcaugcugcucaaccgguucaccauggcgcaccgcaagcccaccuacgagcgcgacguggaccugggcgccggcacgcggcacgucgccguggagcccgagguggccaaccuggacaucaucgggcagcgcaucgagaacaucaagaacgagcacaagagcaccuggcacuacgacgaggacaacccguacaagaccugggccuaccacggcuccuacgaggucaagcccagcggguccgcgagcuccauggugaacggcgucgugcggcuccugaccaagcccugggacgugauccccauggucacgcagaucgccaugaccgacaccaccccguucgggcagcagcgcguguucaaggagaagguggacacgcggacgccccgggccaagcggggcaccgcccagaucauggaggucaccgccaaguggcuguggggcuuccucagccgcaacaagaagccccggaucugcacgcgcgaggaguucacccggaaggugcgcuccaacgcggccaucggggccguguucgucgacgagaaccaguggaacagcgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacaccgccgggugggacacgcggaucaccgaggacgaccugcagaacgaggccaagaucaccgacaucauggagcccgagcacgcccuccuggcgaccuccaucuucaagcugacguaccagaacaaggugguccgcgugcagcgccccgccaagagcggcaccgugauggacgucaucucccggcgcgaccagcgggggagcggccaggugggcaccuacgggcucaacaccuucacgaacauggaggugcagcugauccgccagauggaguccgagggcaucuuccugcccagcgagcucgagaccccgaaccuggccaagaagguccuggacuggcucgagaagcacggggccgagcggcugaagcgcauggccaucuccggcgacgacugcguggugaagcccaucgacgaccgguucgcgaccgcccugaccgcccucaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcugguggggcgggcccgcgugagccagggcgccggguggucccuccgggagacggcgugccugggcaagagcuacgcccagauguggcagcugauguacuuccaccgccgggaccuccgccuggccgccaacgccaucugcuccgcgguccccguggacugggugcccaccagccggaccaccuggagcauccacgcccaccaccaguggaugaccacggaggacaugcuguccgucuggaaccgcguguggaucgaggagaacccguggauggaggacaagacccacgugagcuccugggaggagguccccuaccucgggaagcgggaggaccaguggugcggcagccugaucggccugaccgcccgcgccaccugggcgacgaacauccagguggccaucaaccaggugcgccggcucaucgggaacgagaacuaccuggacuacaugaccuccaugaagcgcuucaagaacgagagcgaccccgagggcgcccugugguga

SEQ ID NO: 7925 - RNA, 9879 nt, Artificial Sequence
  derived and/or modified CDS sequence (opt1) from DENV-1__JX669465__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgcgauggaccugggcgagcucugcgaggacaccaugaccuacaagugcccccggaucaccgaggccgagcccgacgacgucgacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgcguggaagcagauccagaagguggagaccugggcccugcggcaccccggguucaccgugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacacgcagaacaccaccuucaucaucgacgggcccgacaccccggagugccccgacgaccagcgggccuggaacaucugggaggucgaggacuacggcuucgggaucuucacgaccaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagacgugcaucuggcccaagucccacacccuguggagcaacggcguccucgaguccgagauggugauccccaagaccuacgggggcccgaucagccagcacaacuaccggcccggguacuucacccagacggccggccccuggcaccuggggaagcuggagcucgacuucgaccugugcgagggcaccaccguggucguggacgagcacugcggcuaccgcgggccgucccugcggaccacgaccgugaccggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgagauggacagcuucagccucgggauccugugcgucuccauccugaucgaggaggugaugcggagccgcuggucccggaagaugcucaugacgggcacccuggccguguuccugcuccugaucauggggcagcugaccuggaacgaccucauccgccugugcaucauggucggcgccaacgccagcgaccgcauggggaugggcaccacguaccuggcccucauggccaccuucaagaugcggccgauguucgccguggggcugcuguuccgccggcucaccucccgcgaggugcugcugcucaccgucgggcugagccugguggccuccgucgagcuccccaacagccuggaggagcugggcgacgggcucgccaugggcaucaugaugcugaagcugcucacggacuuccagccccaccagcuguggaccacccugcucucccugaccuucauccggacgagccugucccucgacuacgccuggaagaccauggcgauggcccugagcaucgugucccuguucccccucugccugagcaccaccucccagaagacgaccuggcugccggugcuccugggcagcuucgggugcaagccccugaccauguuccucaucaccgagaacaagaucuggggccgcaaguccuggcccaucaacgaggggaucauggccgucggcaucgugagcauccugcuguccagccuccugaagaacgacgugccccuggccgggccgcucaucgcgggcggcaugcugaucgccugcuacgucaucagcggguccagcgccgaccugucccucgagaaggccgccgaggugagcugggaggaggaggcggagcacuccggcaccagccacaacauccugguggagguccaggacgacgggacgaugaagaucaaggacgaggagcgggacgacacccugaccauccuccugaaggccacccugcucgccguguccggcguguaccccaugagcauccccgccacgcuguucgucugguacuucuggcagaagaagaagcagcgcuccggggugcugugggacacccccagcccgcccgagguggagcgggccguccuggacgacggcaucuaccgcauccuccagcggggccugcuggggcgcucccaggugggcgugggggucuuccaggacggcguguuccacaccauguggcacgugacccgcggggcgguccucauguaccagggcaagcgccuggagcccagcugggccuccgugaagaaggaccugaucagcuacggcgggggcuggcgguuccagggguccuggaacacgggcgaggaggugcaggucaucgccguggagcccgggaagaacccgaagaacgugcagaccacccccggcaccuucaagacgcccgagggcgaggucggggccaucgcccucgacuucaagcccggcaccagcggguccccgaucgugaaccgcgagggcaagaucgugggccuguacgggaacggcgucgugaccaccagcgggacguacguguccgcgaucgcccaggccaaggccacccaggagggcccccugcccgagaucgaggacgaggucuucaagaagcggaaccucaccaucauggaccugcacccggggagcggcaagacccgccgguaccugcccgccaucgugcgcgaggcgaucaagcggaagcuccgcacgcugauccuggcccccacccgcguggucgccagcgagauggccgaggcgcucaagggcaugcccauccgguaccagaccaccgccgugaaguccgagcacacggggcgcgagaucguggaccugaugugccacgccaccuucaccaugcggcugcucagcccgguccgcgugcccaacuacaacaugaucaucauggacgaggcccacuucaccgaccccgccuccaucgcggcccggggcuacaucagcacgcgcguggggaugggcgaggccgccgccaucuucaugaccgcgacgccgcccggguccgucgaggccuucccccagagcaacgccgugauccaggacgaggagcgggacauccccgagcgcuccuggaacagcggcuacgacuggaucaccgacuuccccggcaagacggugugguucguccccuccaucaagagcgggaacgacaucgccaacugccugcggaagaacggcaagcgcgugauccagcugucccggaagaccuucgacaccgaguaccagaagaccaagaacaacgacugggacuacguggucacgaccgacaucagcgagaugggggccaacuuccgcgcggaccgggugaucgacccccgccggugccucaagcccgugauccugaaggagggccccgagcgcgucauccuggccgggccgaugcccgugaccgucgccuccgccgcgcagcggcgcggccggaucggccgcaaccagaacaaggagggggaccaguacaucuacaugggccagccccucaacaacgacgaggaccacgcccacuggaccgaggccaagaugcugcuggacaacaucaacacgcccgaggggaucaucccggcccucuucgagcccgagcgcgagaaguccgccgcgaucgacggcgaguaccggcugcgcggggaggcccggaagaccuucguggagcugaugcgccggggcgaccuccccguguggcuguccuacaaggucgccagcgagggcuuccaguacuccgaccgccgguggugcuucgacggggagcgcaacaaccaggugcuggaggagaacauggacguggagaucuggaccaaggagggcgagcggaagaagcuccgcccccgguggcuggacgcccgcaccuacagcgacccgcuggcccuccgggaguucaaggaguucgcggccgggcgccgguccgucagcggcgaccugauccuggagaucggcaagcucccccagcaccugacccugcgcgcccagaacgcccucgacaaccuggugaugcugcacaacagcgagcagggcgggaaggccuaccggcacgcgauggaggagcuccccgacacgaucgagacccugaugcugcucgcccugaucgccgugcugaccgggggcgucacccucuucuuccuguccgggaagggccugggcaagacgagcaucgggcuccugugcgugauggccuccagcgcgcugcucuggauggccuccguggagccccacuggaucgccgccagcaucauccuggaguucuuccugaugguccuccugaucccggagcccgaccgccagcggacgccccaggacaaccagcuggccuacguggugaucggccuccuguucaugauccugaccgucgcggccaacgagauggggcuccuggagaccacgaagaaggaccugggcaucgggcacguggccguggagaaccaccaccacgccaccaugcucgacgucgaccugcgcccggccuccgcguggacccuguacgccguggccaccacggugaucacccccaugaugcggcacaccaucgagaacaccacggccaacaucagccucaccgccaucgcgaaccaggccgccauccugaugggccuggacaagggcuggcccaucuccaagauggacaucggggucccccuccuggcccugggcugcuacagccaggugaacccgcucacccugaccgccgcggugcugaugcucgucgcccacuacgccaucaucgggcccggccugcaggccaaggcgacgcgcgaggcccagaagcgcaccgccgccgggaucaugaagaaccccaccguggacggcaucgugaccaucgaccuggaccccgucguguacgacgccaaguucgagaagcagcucggccagaucaugcugcugauccucugcacgucccagauccugcugaugcggaccaccugggcgcucugcgagagcaucacccuggccacggggccgcugaccacccucugggagggcucccccgggaaguucuggaacaccacgaucgccgugagcauggccaacaucuuccgcggcuccuaccuggccggcgcggggcuggccuucagccucaugaagucccugggcgggggccggcgcgggaccggcgcccagggcgagacccugggggagaaguggaagcggcagcucaaccagcugagcaaguccgaguucaacaccuacaagaaguccggcaucauggaggucgaccgcagcgaggccaaggaggggcugaagcggggcgagacgaccaagcacgccgugucccgcgggaccgcgaagcugcggugguucguggagcgcaaccucgucaagcccgagggcaaggugaucgaccugggcugcgggcggggcggguggagcuacuacugcgccggccugaagaaggugaccgaggucaagggguacaccaagggcggccccgggcacgaggagccgauccccauggccacguacggcuggaaccucgugaagcugcacuccgggaaggacguguucuucacgccgcccgagaagugcgacacccugcucugcgacaucggcgagagcuccccgaaccccaccaucgaggaggggcgcacgcugcggguccugaagaugguggagcccuggcuccgcggcaaccaguucugcaucaagauccugaaccccuacaugccgagcguggucgagacccuggagcagaugcagcggaagcacggcgggaugcucgugcgcaacccccugucccggaacagcacccacgagauguacuggguguccugcggcaccgggaacaucgucagcgccgugaacaugacgucccgcaugcugcucaaccgguucaccauggcgcaccgcaagcccaccuacgagcgcgacguggaccugggcgccggcacccggcacgucgccguggagcccgagguggccaaccuggacaucaucgggcagcgcaucgagaacaucaagaacgagcacaagagcacguggcacuacgacgaggacaacccguacaagaccugggccuaccacggcuccuacgaggucaagcccagcggguccgcgagcuccauggugaacggcgucgugcggcuccugaccaagcccugggacgugauccccauggucacccagaucgccaugacggacaccaccccguucgggcagcagcgcguguucaaggagaagguggacacccggacgccccgcgccaagcggggcaccgcccagaucauggaggucaccgccaaguggcuguggggcuuccucagccgcaacaagaagccccggaucugcacccgcgaggaguucacgcggaaggugcgcuccaacgcggccaucggggccguguucgucgacgagaaccaguggaacagcgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacaccgccgggugggacacccggaucacggaggacgaccugcagaacgaggccaagaucaccgacaucauggagcccgagcacgcccuccuggcgaccuccaucuucaagcugaccuaccagaacaaggugguccgcgugcagcgccccgccaagagcggcacggugauggacgucaucucccggcgcgaccagcgggggagcggccaggugggcaccuacgggcucaacaccuucaccaacauggaggugcagcugauccgccagauggaguccgagggcaucuucagccccuccgagcuggagacgccgaaccucgccaagaagguccuggacuggcuggagaagcacggggccgagcggcucaagcgcauggccaucagcggcgacgacugcguggugaagcccaucgacgaccgguucgcgaccgcccugaccgcccugaacgacauggggaagauccgcaaggacaucccccagugggagcccuccaagggcuggaacgacuggcagcaggucccguucugcagccaccacuuccaccagcucaucaugaaggacggccgggagaucguggugcccugccgcaaccaggacgagcuggucgggcgggcccgcgugucccagggcgccggguggagccugcgggagaccgcgugccucggcaaguccuacgcccagauguggcagcugauguacuuccaccgccgggaccugcgccucgccgccaacgccaucugcagcgcggugcccgucgacugggugcccaccagccggacgaccugguccauccacgcccaccaccaguggaugaccaccgaggacaugcugagcguguggaaccgcgucuggaucgaggagaacccguggauggaggacaagacgcacguguccagcugggaggaggugcccuaccuggggaagcgggaggaccaguggugcggcucccucaucggccugaccgcccgcgccaccugggcgaccaacauccaggucgccaucaaccaggugcgccggcugaucgggaacgagaacuaccucgacuacaugacgagcaugaagcgcuucaagaacgaguccgaccccgagggcgcccugugguga

SEQ ID NO: 7926 - RNA, 9879 nt, Artificial Sequence
  derived and/or modified CDS sequence (opt1) from DENV-1__JX669466__SS-prME
agcgugaccaugcugcucaugcugcugcccaccgcccucgccuuccaccugaccacccgcggcggggagccccacaugaucgucagcaagcaggagcggggcaagagccugcuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgagaagcgguccguggcccuggcgccccacgugggccuggggcucgagacccgcaccgagaccuggaugagcuccgagggcgccuggcggcagauccagcgcgucgagaccugggcccugcggcaccccggguucacggugaucgccuucuuccuggcgcacgccaucggcaccagcaucacccagaaggggaucaucuucauccuccugaugcuggugacccccuccauggccaugcgcugcgucggcaucggcaaccgggacuucguggaggggcucagcggcgccacguggguggacgucgugcuggagcacggguccugcgugaccaccauggccaagaacaagcccacccuggacaucgagcuccugaagacggaggucaccaaccccgcggugcugcgcaagcucugcaucgaggccaagaucagcaacaccaccacggacucccggugcccgacccagggcgaggccacccugguggaggagcaggacgccaacuucgucugccgccggaccuucguggaccgcggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccggaccggccuggacuucaacgagaugguccugcucacgaugaaggagaaguccuggcuggugcacaagcagugguuccuggaccucccgcugcccuggaccuccggggccagcaccagccaggagaccuggaaccgccaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccggcugaagauggacaagcugacccucaagggcauguccuacgucaugugcaccgggagcuucaagcuggagaaggagguggcggagacccagcacggcacgauccuggugcaggucaaguacgagggcaccgacgcccccugcaagauccccuucuccacccaggacgagaagggggugacccagaacggccgccugaucacggccaacccgaucgugaccgacaaggagaagcccgucaacaucgagaccgagccgcccuucggggagagcuacaucguggugggcgccggcgagaaggcgcucaagcuguccugguucaagcgggggagcuccaucggcaagauguucgaggccaccgcccgcggggcccgccggauggccauccugggcgacacggcgugggacuucgggagcaucggcggcgucuucaccuccguggggaagcucgugcaccaggucuucggcaccgccuacggggugcuguucagcggcguguccuggaccaugaagaucgggaucggcauccugcucacguggcugggccugaacagccgcuccaccagccucuccaugaccugcaucgccgucgggauggugacccuguaccugggcgugaugguccaggccgaccucgggugcgugaucaacuggaagggccgggagcugaagugcgggagcggcaucuucgugacgaacgagguccacaccuggaccgagcaguacaaguuccaggccgacuccccgaagcgccugagcgcggccaucggcaaggccugggaggagggggugugcggcauccggagcgccacccgccucgagaacaucauguggaagcagaucuccaacgagcugaaccacauccugcucgagaacgacaugaaguucaccguggucgugggggacgccaacggcauccuggcgcaggggaagaagaugauccggccccagcccauggagcacaaguacagcuggaaguccuggggcaaggccaagaucaucggcgccgacauccagaacacgaccuucaucaucgacgggcccgacaccccggagugccccgacggccagcgcgccuggaacaucugggagguggaggacuacggguucggcgucuucaccacgaacaucuggcugaagcuccgggacagcuacacccagaugugcgaccaccgccugauguccgcggccaucaaggacagcaaggccgugcacgccgacaugggcuacuggaucgaguccgagaagaacgagaccuggaagcuggcccgggcgagcuucaucgaggugaagaccugcacguggcccaagucccacacccucuggagcaacgggguccuggaguccgagaugaucauccccaagaucuucggcgggccgaucagccagcacaacuaccgccccggcuacuucacccagaccgccgggcccuggcaccugggcaagcucgagcuggacuucgaccugugcgagggcacgaccgugguggucgacgagcacugcgggaaccggggcccgucccuccgcaccaccacggugaccgggaagaucauccacgaguggugcugccggagcugcacccugccgccccugcgcuuccggggcgaggacgggugcugguacggcauggagauccgccccgugaaggagaaggaggagaaccucguccgguccauggugagcgccggcuccggggagguggacagcuucagccugggcauccugugcgucuccaucaugaucgaggaggugaugcgcagccgcuggucccggaagaugcucaugaccgggacgcuggccguguuccugcuccugaucaugggccagcugaccuggaacgaccucauccgccugugcaucauggucggggccaacgcgagcgaccggaugggcaugggcaccaccuaccuggcccucauggccacguucaagaugcgcccgauguucgccguggggcugcuguuccggcgccucaccucccgggaggugcugcugcucaccaucggccugagccuggucgccuccguggagcuccccaacagccuggaggagcugggggacggccucgcgaugggcaucaugaugcugaagcugcucaccgaguuccagccccaccagcuguggacgacccugcucucccugaccuucgucaagaccacgcugagccucgacuacgccuggaagaccaccgccauggugcuguccaucgugagccuguucccccucugccuguccaccacgagccagaagaccaccuggcugccgguccuccugggguccuucggcugcaagccccugaccauguuccucaucaccgagaacaagaucugggggcgcaagagcuggccccugaacgagggcaucauggccaucgggaucguguccauccugcucagcucccugcugaagaacgacgugccccucgcgggcccgcugaucgccggcgggaugcugaucgccugcuacgucaucagcggcagcuccgccgaccucagccuggagaaggccgcggagguguccugggagcaggaggccgagcacagcggggccucccacaacauccugguggagguccaggacgacggcacgaugaagaucaaggacgaggagcgggacgacacccucaccauccugcugaaggccacccuccuggccgugagcgggguguaccccauguccauccccgcgacgcuguucgucugguacuucuggcagaagaagaagcagcgcagcggcgugcucugggacacccccuccccgcccgagguggagcgggccguccuggacgacggcaucuaccgcauccugcagcgggggcugcucggccgcagccaggugggggugggcgucuuccaggacgggguguuccacaccauguggcacgugacccggggcgccguccugauguaccagggcaagcgccuggagcccuccugggccagcgugaagaaggaccucaucuccuacgggggcggguggcgguuccagggcagcuggaacacgggggaggaggugcaggucaucgccguggagcccggcaagaacccgaagaacgugcagaccacccccggcaccuucaagacgcccgagggggaggucggcgcgaucgcccuggacuucaagcccgggaccuccggcagcccgaucgugaaccgcgagggcaagaucguggggcuguacggcaacggggucgugaccaccuccggcacguacgugagcgccaucgcccaggccaaggcgucccaggaggggccccuccccgagaucgaggacgaggucuucaagaagcggaaccugaccaucauggaccugcacccgggcagcggcaagacccgccgguaccuccccgccaucgugcgcgaggccaucaagcgcaagcugcggacccugauccucgcccccacgcgcguggucgcgagcgagauggccgaggcccugaaggggaugcccauccgguaccagaccaccgccgugaaguccgagcacaccggccgcgagaucguggaccugaugugccacgccacguucaccaugcggcuccugagcccgguccgcgugcccaacuacaacaugaucaucauggacgaggcgcacuucaccgaccccgccuccaucgccgcccggggguacaucagcacccgcgugggcaugggggaggccgcggccaucuucaugacggccacgccgcccggcuccgucgaggccuucccccagagcaacgccgugauccaggacgaggagcgggacauccccgagcgcuccuggaacagcggcuacgacuggaucaccgacuuccccgggaagaccgugugguucguccccuccaucaagagcggcaacgacaucgcgaacugccugcggaagaacgggaagcgcgugauccagcucucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccugaaggacgggcccgagcgcgucauccucgccggcccgaugcccgugaccgucgcguccgccgcccagcggcgcggccgcaucgggcggaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcuguccuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcgcgcaccuacagcgacccgcucgcccugcgggaguucaaggaguucgccgccggccgccgguccgugagcggcgaccugauccucgagaucgggaagcugccccagcaccugacccuccgcgcccagaacgcgcuggacaaccuggugaugcuccacaacagcgagcagggcgggaaggccuaccggcacgccauggaggagcugcccgacaccaucgagacgcugaugcuccuggcccugaucgcgguccucaccggcggggugacccuguucuuccuguccggcaagggccucgggaagaccagcaucggccugcugugcgugacggccuccagcgcccuccuguggauggccuccgucgagccccacuggaucgccgcgagcaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcacccggccuccgccuggacccucuacgccguggcgaccacggugaucacccccaugaugcgccacaccaucgagaacaccacggccaacaucagccugaccgccaucgccaaccaggccgcgauccugaugggccucgacaagggguggcccaucuccaagauggacaucggcgucccccugcuggcccucgggugcuacagccaggugaacccgcugacccugaccgccgccgugcucaugcuggucgcgcacuacgccaucaucggccccgggcugcaggccaaggccacgcgcgaggcccagaagcggaccgcggccggcaucaugaagaaccccaccguggacggcaucguggccaucgaccucgaccccgucguguacgacgccaaguucgagaagcagcuggggcagaucaugcugcucauccugugcaccucccagauccugcucaugcgcacgaccugggcccugugcgagagcaucacccuggcgaccggcccgcucacgacccugugggaggggucccccggcaaguucuggaacaccaccaucgccgugagcauggccaacaucuuccggggcuccuaccuggccggggccggccucgcguucagccugaugaagucccucgggggcgggcgccggggcacgggcgcccagggggagacccucggcgagaaguggaagcgccagcugaaccagcugagcaaguccgaguucaacaccuacaagcggagcgggaucauggaggucgaccgcagcgaggccaaggagggccucaagcgcggggagaccacgaagcacgccgugucccgcggcaccgcgaagcugcggugguucguggagcgcaaccuggucaagcccgagggcaaggugaucgaccuggggugcggccgcgggggcuggagcuacuacugcgccgggcucaagaaggugaccgaggucaagggcuacaccaagggcgggcccggccacgaggagccgauccccauggccaccuacggguggaaccuggugaagcugcacuccggcaaggacguguucuucaugccgcccgagaagugcgacacgcuccugugcgacaucggggagagcuccccgaaccccaccaucgaggagggccgcacccugcggguccucaagaugguggagcccuggcugcgcggcaaccaguucugcaucaagauccugaaccccuacaugccgagcguggucgagacccucgagcagaugcagcggaagcacgggggcaugcuggugcgcaacccccugucccggaacagcacgcacgagauguacuggguguccugcgggaccggcaacaucgucagcgccgugaacaugaccucccgcaugcuccugaaccgcuucaccauggcccaccggaagcccacguacgagcgcgacguggaccugggcgcggggacccggcacgucgccguggagcccgagguggccaaccucgacaucaucggccagcgcaucgagaacaucaagaacgagcacaagagcaccuggcacuacgacgaggacaacccguacaagaccugggccuaccacggguccuacgaggucaagcccagcggcuccgccagcuccauggugaacggggucgugcggcugcugacgaagcccugggacgugauccccauggucacccagaucgcgaugaccgacaccacgccguucggccagcagcgcguguucaaggagaagguggacacccggacgccccgggccaagcggggcaccacgcagaucauggaggucaccgccaaguggcucuggggguuccugagccgcaacaagaagccccggaucugcacccgcgaggaguucacccggaaggugcgcuccaacgccgccaucggcgcgguguucgucgacgagaaccaguggaacagcgccaaggaggccguggaggacgagcgguucugggaccuggugcaccgcgagcgggagcuccacaagcaggggaagugcgccacgugcgucuacaacaugaugggcaagcgcgagaagaagcugggggaguucggcaaggcgaagggcagccgggccaucugguacauguggcugggggcccgcuuccucgaguucgaggcccugggcuucaugaacgaggaccacugguucucccgggagaacagccuguccgggguggagggcgaggggcuccacaagcugggcuacauccugcgcgacaucagcaagaucccgggcgggaacauguacgccgacgacaccgcgggcugggacacccgcaucaccgaggacgaccuccagaacgaggccaagaucacggacaucauggagcccgagcacgcccugcuggccaccuccaucuucaagcucaccuaccagaacaaggugguccgggugcagcgccccgccaagaacgggaccgugauggacgucaucagccggcgcgaccagcggggcuccggccagguggggacguacggccugaacaccuucaccaacauggaggugcagcugauccgccagauggagagcgaggggaucuuccuccccuccgagcuggagaccccgaaccuggcggagcgggcccucgacuggcuggagaagcacggcgccgagcgccugaagcggauggccaucagcggggacgacugcgucgugaagcccaucgacgaccgcuucgccacggcgcucaccgcccugaacgacaugggcaaggugcggaaggacaucccccagugggagcccuccaagggcuggaacgacuggcagcaggucccguucugcagccaccacuuccaccagcugaucaugaaggacgggcgcgagaucguggugcccugccggaaccaggacgagcucgucggccgcgcccgggugucccagggggccggcuggagccugcgcgagaccgccugccuggggaaguccuacgcgcagauguggcagcucauguacuuccaccggcgcgaccugcggcuggccgccaacgccaucugcagcgcggugcccgucgacugggugcccgccucccgcaccaccuggagcauccacgcccaccaccaguggaugacgaccgaggacaugcucagcguguggaaccgcgucuggaucgaggagaacccguggauggaggacaagacccacguguccagcugggaggaggugcccuaccugggcaagcgggaggaccaguggugcggcucccugaucgggcucaccgcccgcgccacgugggcgaccaacauccaggucgccaucaaccaggugcggcgccugaucggcaacgagaacuaccuggacuacaugaccagcaugaagcgguucaagaacgaguccgaccccgagggggcccucugguga

SEQ ID NO: 7927 - RNA, 9879 nt, Artificial Sequence
  derived and/or modified CDS sequence (opt1) from DENV-1__JX669467__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgagcagcgcgccuggaacaucugggaggucgaggacuacggcuucgggaucuucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagauguacgggggcccgaucucccagcacaacuaccgccccggguacuucacccagaccgccggccccuggcaccuggggaagcucgagcuggacuucgaccugugcgagggcacgaccgugguggucgacgagcacugcggcagccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucguccgguccauggugagcgccggcagcggcgagguggacuccuucagccuggggauccugugcgucuccaucaugaucgaggaggugaugcgcagccgguggucccgcaagaugcucaugaccggcacgcuggccguguuccugcuccugaucauggggcagcugaccuggaacgaccucauccgccugugcaucauggucggcgccaacgcgagcgacaagauggggaugggcaccaccuaccuggcccucauggccacguucaagaugcggccgauguucgccguggggcugcuguuccgccggcucaccucccgcgaggugcugcugcucaccaucgggcugagccuggucgccuccguggagcuccccaacagccuggaggagcugggcgacgggcucgcgaugggcaucaugaugcugaagcugcucaccgaguuccagccccaccagcuguggacgacccugcucucccugaccuucaucaagaccacgcugagccucgacuacgccuggaagaccaccgccaccguccuguccaucgugagccuguucccccucugccuguccacgaccagccagaagaccaccuggcugccggugcuccugggcuccuucgggugcaagccccugaccauguuccucaucacggagaacgagaucuggggccgcaagagcuggccccugaacgaggggaucauggccaucggcaucgucuccauccugcucagcagccugcugaagaacgacgugccccucgcggggccgcugaucgccggcggcaugcugaucgccugcuacgugaucuccgggagcuccgccgaccucagccuggagaaggccgcggaggucuccugggaggaggaggccgagcacagcggcaccucccacaacauccugguggaggugcaggacgacgggaccaugaagaucaaggacgaggagcgcgacgacacccucacgauccugcugaaggccacccuccuggccgucagcggcguguaccccauguccauccccgccacccuguucgugugguacuucuggcagaagaagaagcagcggagcgggguccucugggacacccccuccccgcccgagguggagcgcgcggugcuggacgacggcaucuaccggauccugcagcgcggccugcucgggcggagccaggucggcguggggguguuccaggacggcgucuuccacacgauguggcacgugacccgcggggccgugcugauguaccagggcaagcggcuggagcccuccugggccagcgucaagaaggaccucaucuccuacggcgggggcuggcgcuuccaggggagcuggaacaccggcgaggagguccaggugaucgccgucgagcccgggaagaacccgaagaacgugcagaccacgcccggcaccuucaagacccccgagggcgaggugggggccaucgcgcuggacuucaagcccggcaccuccgggagcccgaucgucaaccgggagggcaagaucgugggccuguacgggaacggcguggucacgaccuccgggaccuacgugagcgccaucgcccaggccaaggccagccaggagggcccccuccccgagaucgaggacgagguguucaagaagcgcaaccugaccaucauggaccugcacccgggguccggcaagacgcggcgcuaccuccccgcgaucguccgggaggccaucaagcgcaagcugcggacccugauccucgcccccacccgcgugguggccagcgagauggcggaggcccugaagggcaugcccauccgcuaccagaccacggccgucaaguccgagcacaccgggcgggagaucguggaccugaugugccacgccaccuucaccaugcgccuccugagcccggugcggguccccaacuacaacaugaucaucauggacgaggcccacuucacggaccccgcguccaucgccgcccgcggcuacaucagcacccggguggggaugggcgaggccgccgcgaucuucaugaccgccacgccgcccggguccguggaggccuucccccagagcaacgccgucauccaggacgaggagcgcgacauccccgagcgguccuggaacagcggcuacgacuggaucacggacuuccccggcaagaccgugugguucgugcccuccaucaagagcgggaacgacaucgccaacugccugcgcaagaacggcaagcgggucauccagcucucccgcaagaccuucgacaccgaguaccagaagacgaagaacaacgacugggacuacguggugaccaccgacaucagcgagaugggggcgaacuuccgggccgaccgcgucaucgacccccggcgcugccugaagcccgugauccugaaggacggccccgagcgggugauccucgccgggccgaugcccgucaccguggccuccgcggcccagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccgcucgcgcugcgcgaguucaaggaguucgccgccgggcggcgcagcgucuccggcgaccugauccucgagaucggcaagcugccccagcaccugacgcuccgggcccagaacgcccuggacaaccuggugaugcuccacaacagcgagcagggcgggaaggcguaccgccacgccauggaggagcugcccgacaccaucgagacccugaugcuccuggcccugaucgccgugcucaccgggggcgucacgcuguucuuccuguccgggaagggccucggcaagaccagcaucgggcugcugugcgugaccgcguccagcgcccuccuguggauggccuccguggagccccacuggaucgccgccagcaucauccuggaguucuuccucaugguccugcugaucccggagcccgaccggcagcgcacgccccaggacaaccagcucgcguacguggugaucggccugcuguucaugauccucacggucgccgccaacgagauggggcugcuggagaccaccaagaaggaccucggcaucgggcacguggccgccgagaaccaccagcacgcgaccaugcuggacguggaccugcacccggccuccgccuggacgcucuacgccgucgccaccaccgugaucacccccaugaugcggcacacgaucgagaacaccaccgcgaacaucagccugaccgccaucgccaaccaggccgccauccugaugggccucgacaagggcuggcccaucuccaagauggaccugggggugccccugcucgcgcugggcugcuacagccaggucaacccgcugacgcucaccgccgccgugcugaugcugguggcccacuacgcgaucaucgggcccggccuccaggccaaggccacccgcgaggcccagaagcggaccgccgcggggaucaugaagaaccccacggucgacggcaucguggccaucgaccuggaccccguggucuacgacgccaaguucgagaagcagcugggccagaucaugcuccugauccugugcaccucccagauccuccugaugcgcaccaccugggcccugugcgagagcaucacgcucgccaccgggccgcugaccacccugugggagggcucccccgggaaguucuggaacacgaccaucgcggugagcauggccaacaucuuccgcggcuccuaccucgccggcgccgggcuggccuucagccugaugaagucccucggcgggggccggcgcgggaccggcgcgcagggcgagacccugggggagaaguggaagcggcagcugaaccagcucagcaagagcgaguucaacacguacaagcgcuccggcaucauggagguggaccggagcgaggccaaggaggggcugaagcgcggcgagaccaccaagcacgccgucucccgggggaccgccaagcugcgcugguucguggagcggaaccuggugaagcccgagggcaaggucaucgaccucggcugcgggcgcggcggguggagcuacuacugcgcgggccugaagaaggugaccgaggugaagggguacacgaagggcggccccgggcacgaggagccgauccccauggccaccuacggcuggaaccuggucaagcuccacuccgggaaggacguguucuucaugccgcccgagaagugcgacacccugcugugcgacaucggcgagagcuccccgaaccccaccaucgaggaggggcggacgcuccgcgugcugaagauggucgagcccuggcugcggggcaaccaguucugcaucaagauccucaaccccuacaugccgagcgugguggagacccuggagcagaugcagcgcaagcacggcgggaugcugguccggaacccccucucccgcaacagcacccacgagauguacuggguguccugcggcaccgggaacaucgugagcgccgucaacaugacgucccggaugcugcugaaccgcuucaccauggcccaccggaagcccaccuacgagcgcgacguggaccucggcgccggcacccgccacguggcggucgagcccgagguggccaaccuggacaucaucgggcagcggaucgagaacaucaagaacgagcacaagagcacguggcacuacgacgaggacaacccguacaagaccugggccuaccacggcuccuacgaggugaagcccagcggguccgccagcuccauggucaacggcgugguccgccugcucaccaagcccugggacgugauccccauggugacccagaucgccaugacggacaccaccccguucgggcagcagcgggucuucaaggagaagguggacacccgcacgccccgggcgaagcgcggcaccgcccagaucauggaggugaccgccaaguggcuguggggcuuccugagccggaacaagaagccccgcaucugcacccgggaggaguucacgcgcaagguccggagcaacgccgccaucggggcgguguucguggacgagaaccaguggaacuccgccaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggcgaagggcagccgcgccaucugguacauguggcucggcgcccgguuccuggaguucgaggcccugggguucaugaacgaggaccacugguucucccgcgagaacagccucuccggcgucgagggggagggccugcacaagcugggguacauccuccgggacaucagcaagaucccgggcggcaacauguacgccgacgacaccgcggggugggacacccgcaucacggaggacgaccugcagaacgaggccaagaucaccgacaucauggagcccgagcacgcccugcucgccaccuccaucuucaagcugaccuaccagaacaagguggugcggguccagcgccccgccaagaacggcacggugauggacgugaucagccgccgggaccagcgcggguccggccaggucggcaccuacgggcugaacaccuucaccaacauggaggugcagcucauccggcagauggagagcgagggcaucuucuuccccuccgagcuggagagcccgaaccuggcggagcgcgugcucgacuggcuggagaagcacggggccgagcggcugaagcgcauggccaucuccggcgacgacugcgucgugaagcccaucgacgaccgguucgccacggcccucaucgcgcugaacgacauggggaaggugcgcaaggacaucccccagugggagcccagcaagggcuggaacgacuggcagcaggucccguucugcucccaccacuuccaccagcugaucaugaaggacggccgggagaucguggugcccugccgcaaccaggacgagcucgucgggcgggcccgcgugagccagggcgccggguggucccugcgggagaccgccugccugggcaagagcuacgcccagauguggcagcucauguacuuccaccgccgggaccugcgccuggcggccaacgccaucugcagcgccgugcccgucgacugggugcccaccucccggaccaccuggagcauccacgcgcaccaccaguggaugacgaccgaggacaugcucuccguguggaaccgcgucuggaucgaggagaacccguggauggaggacaagacccacgugagcuccugggaggaggugcccuaccuggggaagcgggaggaccaguggugcggcagccugaucggccucaccgcccgcgccacgugggccaccaacauccaggucgccaucaaccaggugcgccggcugaucgggaacgagaacuaccuggacuacaugaccuccaugaagcgcuucaagaacgagagcgaccccgagggcgcgcucugguga

SEQ ID NO: 7928 - RNA, 9879 nt, Artificial Sequence
  derived and/or modified CDS sequence (opt1) from DENV-1__HM469967__SS-prME
agcgugaccaugcugcucaugcugaugcccaccgcccuggccuuccaccucaccacccggggcggggagccccacaugaucgucagcaagcaggagcggggcaagagccugcuguucaagaccagcgcgggggugaacaugugcacccucaucgccauggaccugggcgagcugugcgaggacaccaugaccuacaagugcccccgcaucaccgaggccgagcccgacgacguggacugcuggugcaacgccaccgacacgugggucaccuacgggaccugcagccagaccggcgagcaccggcgggacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccaagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgagaucggcgccaucgcgcuggacuucaagcccgggacgagcggcucccccaucgucaaccgggaggggaagaucgugggccuguacggcaacgggguggucaccaccagcggcaccuacgugagcgccaucgcccaggccaaggcgucccaggaggggccgcuccccgagaucgaggacgagguguuccgcaagcggaaccugacgaucauggaccugcaccccggcagcgggaagacccgccgguaccucccggccaucguccgcgaggccaucaagcggaagcugcgcacccugauccucgcccccacccgcgugguggccuccgagauggcggaggcccugaagggcaugcccauccgguaccagacgaccgccgucaagagcgagcacaccggcaaggagaucguggaccugaugugccacgccaccuucacgaugcgccuccugucccccgugcgggucccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccguggaggccuucccgcagagcaacgccgucauccaggacgaggagcgcgacauccccgagcgguccuggaacagcggguacgaguggaucaccgacuuccccggcaagaccgugugguucgugcccuccaucaaggccggcaacgacaucgcgaacugccugcgcaagaacgggaagcgggucauccagcucagccgcaagaccuucgacacggaguaccagaagaccaagaacuccgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucacgguggccuccgcggcccagcgccgggggcgcgucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgcggccaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcgcugcgcgaguucaaggaguucgccgccggccggcgcagcgucuccggggaccugauccucgagaucggcaagcugccgcagcaccugacccagcgggcccagaacgcgcucgacaaccuggugaugcugcacaacagcgagcagggcgggcgcgccuaccggcacgccauggaggagcuccccgacaccaucgagacgcugaugcugcucgcccugaucgccgugcugaccggcggggucacccucuucuuccuguccggccgcgggcugggcaagaccagcaucggccuccugugcgugauggcguccagcgugcugcucuggauggccuccgucgagccccacuggaucgccgccagcaucauccuggaguucuuccugauggugcuccugauccccgagccggaccggcagcgcacgccccaggacaaccagcuggccuacguggucaucgggcuccuguucaugauccugacgguggcggccaacgagaugggccuccuggagaccaccaagaaggaccuggggaucggccacguggccgucgagaaccaccaccacgccgccaugcucgacguggaccugcaccccgcguccgccuggacccuguacgccguggccacgaccaucaucaccccgaugaugcggcacaccaucgagaacacgaccgccaacaucagccucaccgcgaucgccaaccaggccgccauccugauggggcuggacaagggcuggcccaucuccaagauggacaucggcgucccccuccuggcgcuggggugcuacagccaggugaacccccucacccugacggccgccgugcugaugcucgucgcccacuacgccaucaucggcccggggcugcaggcgaaggccacccgcgaggcccagaagcgcaccgccgccggcaucaugaagaaccccaccguggacgggaucguggcgaucgaccuggaccccgucguguacgacgccaaguucgagaagcagcucggccagaucaugcugcugauccucugcacgucccagauccugcugaugcggaccaccugggcccucugcgagagcaucacccuggccacgggcccccugaccacccucuggaagggguccccgggcaaguucuggaacaccacgaucgccgugagcauggcgaacaucuuccgcggguccuaccuggccggcgccggccuggccuucagccucaugaagucccucgggggcgggcggcgcgggaccggggcgcagggcgagacccugggcgagaaguggaagcggcagcucaaccagcuguccaagagcgaguucaacaccuacaagcgcuccgggaucauggaggucgaccggagcgaggccaaggagggccugaagcgcggggagacgaccaagcacgccgugucccggggcaccgccaagcucaagugguucguggagcgcaaccuggucaagcccgaggggaaggugaucgaccugggcugcggccgcgggggcuggagcuacuacugcgccgggcugaagaaggugaccgaggucaagggcuacacgaagggcggccccggccacgaggagcccaucccgauggcgaccuacggguggaaccucgugaagcugcacuccggcaaggacguguucuucaucccgcccgagaagugcgacacccugcucugcgacaucggggagagcucccccaacccgaccaucgaggagggccgcacgcugcggguccugaagaugguggagcccuggcuccgcaagaaccaguucugcaucaagauccugaaccccuacaugcccagcguggucgagacccuggagcagaugcagcggaagcacgggggcaugcucgugcgcaacccgcugucccggaacagcacccacgagauguacuggguguccugcggcaccgggaacaucgucagcgccgugaacaugaccucccgcaugcugcucaaccgguucacgauggcccaccgcaagcccaccuacgagcgcgacguggaccugggcgccgggacccggcacgucgccguggagcccgagguggcgaaccuggacaucaucggccagcgcaucgagaacaucaagcacgagcacaagagcaccuggcacuacgacgaggacaaccccuacaagacgugggccuaccacggcuccuacgaggucaagccgagcggguccgccagcagcauggugaacggcgucgugaagcuccugaccaagcccugggacgugauccccauggucacccagaucgccaugaccgacacgacccccuucgggcagcagcggguguucaaggagaagguggacacccgcaccccgaaggccaagcggggcacggcgcagaucauggaggucaccgcccgcuggcuguggggguuccucucccggaacaagaagccccgcaucugcacccgggaggaguucacccgcaaggugcggagcaacgccgccaucggcgcgguguucgucgacgagaaccaguggaacuccgccaaggaggccguggaggacgagcgcuucugggaccuggugcaccgggagcgcgagcugcacaagcagggcaagugcgccacgugcgucuacaacaugauggggaagcgggagaagaagcucggcgaguucgggaaggccaagggcagccgcgcgaucugguacauguggcugggggcccgguuccuggaguucgaggcccucggcuucaugaacgaggaccacugguucucccgcgagaacagccuguccggcguggagggggagggccugcacaagcucggguacauccugcgggacaucagcaagauccccggcgggaacauguacgccgacgacaccgccggcugggacacccgcaucaccgaggacgaccugcagaacgaggcgaagaucacggacaucauggagccggagcacgcccuccuggccaaguccaucuucaagcugaccuaccagaacaaggugguccgggugcagcgccccgccaagaacggcaccgugauggacgucaucagccgccgggaccagcgcggguccggccagguggggaccuacggccucaacacguucaccaacauggaggcccagcugauccggcagauggagagcgagggcaucuucucccccagcgagcuggagacccccaaccucgcggagcgcgugcuggacuggcuggagaaguacggggucgagcggcucaagcgcauggccaucuccggcgacgacugcguggugaagccgaucgacgaccgguucgccaccgcccugacggcccugaacgacauggggaagguccgcaaggacaucccccagugggagcccagcaagggcuggaacgacuggcagaaggugcccuucugcucccaccacuuccaccagcucaucaugaaggacgggcgggagaucguggucccgugccgcaaccaggacgagcuggugggccgggcgcgcgugagccagggcgccggguggagccugcgggagaccgccugccucggcaaguccuacgcccagauguggcagcugauguacuuccaccgccgggaccugcgccucgcggccaacgccaucugcagcgccguccccguggacugggugcccaccucccggaccacguggagcauccacgcccaccaccaguggaugaccaccgaggacaugcuguccgucuggaaccgcguguggaucgaggagaaccccuggauggaggacaagacccacaucagcuccugggaggacgugccguaccuggggaagcgggaggaccaguggugcggcagccucaucgggcugacggcgcgcgccaccugggccaccaacauccaggucgccaucaaccaggugcgccggcugaucggcaacgagaacuaccucgacuacaugaccuccaugaagcgcuucaagaacgagagcgaccccgagggcgcccugugguga

SEQ ID NO: 7929 - RNA, 9879 nt, Artificial Sequence
  derived and/or modified CDS sequence (opt1) from DENV-1__JX669468__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcgggaacggcaucuucgucaccaacgaggugcacaccuggaccgagcaguacaaguuccaggccgacuccccgaagcggcugagcgcggccaucggccgcgccugggaggagggggugugcggcauccggagcgccacccgccucgagaacaucauguggaagcagaucuccaacgagcugaaccacauccugcucgagaacgacaucaaguucacggucgugguggggaacgccaacggcauccuggcgcaggggaagaagaugauccggccccagcccauggagcacaaguacagcuggaaguccuggggcaaggccaagaucaucggcgccgacauccagaacaccaccuucaucaucgacgggcccgacaccccggagugccccgacgagcagcgcgccuggaacaucugggaggucgaggacuacggcuucgggaucuucacgaccaacaucuggcugaagcuccgggacagcuacacccagaugugcgaccaccgccugauguccgcggccaucaaggacagcaaggccgugcacgccgacaugggcuacuggaucgaguccgagaagaacgagaccuggaagcuggcccgggcgagcuucaucgaggugaagacgugcaucuggcccaagucccacacccucuggagcaacggcguccuggaguccgagaugaucauccccaagauguacgggggcccgaucagccagcacaacuaccgccccggguacuucacccagaccgccggccccuggcaccuggggaagcucgagcuggacuucgaccugugcgagggcacgaccgugguggucgacgagcacugcggcucccgggggccgagccuccgcaccaccacggugaccggcaagaucauccacgaguggugcugccgguccugcacccugccgccccugcgcuuccgcggggaggacggcugcugguacgggauggagauccgccccgugaaggagaaggaggagaaccucguccggagcaugguguccgccggcagcggcgagguggacagcuucucccuggggauccugugcgucagcaucaugaucgaggaggugaugcgcucccgguggagccgcaagaugcucaugaccggcacgcuggccguguuccugcuccugaucauggggcagcugaccuggaacgaccucauccgccugugcaucauggucggcgccaacgcguccgacaagauggggaugggcaccaccuaccuggcccucauggccacguucaagaugcggccgauguucgccguggggcugcuguuccgccggcucaccagccgcgaggugcugcugcucaccaucgggcugucccuggucgccagcguggagcuccccaacucccuggaggagcugggcgacgggcucgcgaugggcaucaugaugcugaagcugcucaccgaguuccagccccaccagcuguggacgacccugcucagccugaccuucaucaagaccacgcugucccucgacuacgccuggaagaccaccgccaccguccugagcaucgugucccuguucccccucugccugagcacgaccucccagaagaccaccuggcugccggugcuccugggcagcuucgggugcaagccccugaccauguuccucaucacggagaacgagaucuggggccggaaguccuggccccugaacgaggggaucauggccaucggcaucgucagcauccugcucuccagccugcugaagaacgacgugccccucgcggggccgcugaucgccggcggcaugcugaucgccugcuacgugaucagcggguccagcgccgaccucucccuggagaaggccgcggaggucagcugggaggaggaggccgagcacuccggcaccagccacaacauccugguggaggugcaggacgacgggaccaugaagaucaaggacgaggagcgcgacgacacccucacgauccugcugaaggccacccuccuggccgucuccggcguguaccccaugagcauccccgccacccuguucgugugguacuucuggcagaagaagaagcagcgguccgggguccucugggacacccccagcccgcccgagguggagcgcgcggugcuggacgacggcaucuaccggauccugcagcgcggccugcucgggcggucccaggucggcguggggguguuccaggacggcgucuuccacacgauguggcacgugacccgcggggccgugcugauguaccagggcaagcggcuggagcccagcugggccuccgucaagaaggaccucaucagcuacggcgggggcuggcgcuuccagggguccuggaacaccggcgaggagguccaggugaucgccgucgagcccgggaagaacccgaagaacgugcagaccacgcccggcaccuucaagacccccgagggcgaggugggggccaucgcgcuggacuucaagcccggcaccagcggguccccgaucgucaaccgggagggcaagaucgugggccuguacgggaacggcguggucacgaccagcgggaccuacguguccgccaucgcccaggccaaggccagccaggagggcccccuccccgagaucgaggacgagguguucaagaagcgcaaccugaccaucauggaccugcacccggggagcggcaagacgcggcgcuaccuccccgcgaucguccgggaggccaucaagcgcaagcugcggacccugauccucgcccccacccgcgugguggccuccgagauggcggaggcccugaagggcaugcccauccgcuaccagaccacggccgucaagagcgagcacaccgggcgggagaucguggaccugaugugccacgccaccuucaccaugcgccuccuguccccggugcggguccccaacuacaacaugaucaucauggacgaggcccacuucacggaccccgcgagcaucgccgcccgcggcuacaucuccacccggguggggaugggcgaggccgccgcgaucuucaugaccgccacgccgcccgggagcguggaggccuucccccaguccaacgccgucauccaggacgaggagcgcgacauccccgagcggagcuggaacuccggcuacgacuggaucacggacuuccccggcaagaccgugugguucgugcccagcaucaaguccgggaacgacaucgccaacugccugcgcaagaacggcaagcgggucauccagcucagccgcaagaccuucgacaccgaguaccagaagacgaagaacaacgacugggacuacguggugaccaccgacaucuccgagaugggggcgaacuuccgggccgaccgcgucaucgacccccggcgcugccugaagcccgugauccugaaggacggccccgagcgggugauccucgccgggccgaugcccgucaccguggccagcgcggcccagcgccggggccgcaucggccggaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgcgagaaguccgcggccaucgacggcgaguaccgccugcgcggggaggcccgcaagaccuucguggagcucaugcggcgcggcgaccugcccguguggcugagcuacaaggucgccuccgagggcuuccaguacagcgaccggcgcuggugcuucgacggggagcggaacaaccaggugcucgaggagaacauggacguggagaucuggaccaaggagggcgagcgcaagaagcugcggccccgcuggcuggacgcccggaccuacuccgacccgcucgcgcugcgcgaguucaaggaguucgccgccgggcggcgcagcgucagcggcgaccugauccucgagaucggcaagcugccccagcaccugacgcuccgggcccagaacgcccuggacaaccuggugaugcuccacaacuccgagcagggcgggaaggcguaccgccacgccauggaggagcugcccgacaccaucgagacccugaugcuccuggcccugaucgccgugcucaccgggggcgucacgcuguucuuccugagcgggaagggccucggcaagaccuccaucgggcugcugugcgugaccgcgagcuccgcccuccuguggauggccagcguggagccccacuggaucgccgccuccaucauccuggaguucuuccucaugguccugcugaucccggagcccgaccggcagcgcacgccccaggacaaccagcucgcguacguggugaucggccugcuguucaugauccucacggucgccgccaacgagauggggcugcuggagaccaccaagaaggaccucggcaucgggcacguggccgccgagaaccaccagcacgcgaccaugcuggacguggaccugcacccggccagcgccuggacgcucuacgccgucgccaccaccgugaucacccccaugaugcggcacacgaucgagaacaccaccgcgaacaucucccugaccgccaucgccaaccaggccgccauccugaugggccucgacaagggcuggcccaucagcaagauggaccugggggugccccugcucgcgcugggcugcuacucccaggucaacccgcugacgcucaccgccgccgugcugaugcugguggcccacuacgcgaucaucgggcccggccuccaggccaaggccacccgcgaggcccagaagcggaccgccgcggggaucaugaagaaccccacggucgacggcaucguggccaucgaccuggaccccguggucuacgacgccaaguucgagaagcagcugggccagaucaugcuccugauccugugcaccagccagauccuccugaugcgcaccaccugggcccugugcgaguccaucacgcucgccaccgggccgcugaccacccugugggagggcagccccgggaaguucuggaacacgaccaucgcgguguccauggccaacaucuuccgcggcagcuaccucgccggcgccgggcuggccuucucccugaugaagucccucggcgggggccggcgcgggaccggcgcgcagggcgagacccugggggagaaguggaagcggcagcugaaccagcucuccaagagcgaguucaacacguacaagcgcagcggcaucauggagguggaccgguccgaggccaaggaggggcugaagcgcggcgagaccaccaagcacgccgucagccgggggaccgccaagcugcgcugguucguggagcggaaccuggugaagcccgagggcaaggucaucgaccucggcugcgggcgcggcgggugguccuacuacugcgcgggccugaagaaggugaccgaggugaagggguacacgaagggcggccccgggcacgaggagccgauccccauggccaccuacggcuggaaccuggucaagcuccacagcgggaaggacguguucuucaugccgcccgagaagugcgacacccugcugugcgacaucggcgaguccagcccgaaccccaccaucgaggaggggcggacgcuccgcgugcugaagauggucgagcccuggcugcggggcaaccaguucugcaucaagauccucaaccccuacaugccguccgugguggagacccuggagcagaugcagcgcaagcacggcgggaugcugguccggaacccccucagccgcaacuccacccacgagauguacugggugagcugcggcaccgggaacaucguguccgccgucaacaugacgagccggaugcugcugaaccgcuucaccauggcccaccggaagcccaccuacgagcgcgacguggaccucggcgccggcacccgccacguggcggucgagcccgagguggccaaccuggacaucaucgggcagcggaucgagaacaucaagaacgagcacaaguccacguggcacuacgacgaggacaacccguacaagaccugggccuaccacggcagcuacgaggugaagcccuccgggagcgccuccagcauggucaacggcgugguccgccugcucaccaagcccugggacgugauccccauggugacccagaucgccaugacggacaccaccccguucgggcagcagcgggucuucaaggagaagguggacacccgcacgccccgggcgaagcgcggcaccgcccagaucauggaggugaccgccaaguggcuguggggcuuccugucccggaacaagaagccccgcaucugcacccgggaggaguucacgcgcaagguccggagcaacgccgccaucggggcgguguucguggacgagaaccaguggaacagcgccaaggaggccgucgaggacgagcgcuucugggaccucgugcaccgggagcgcgagcugcacaagcagggcaagugcgcgaccugcguguacaacaugauggggaagcgggagaagaagcugggcgaguucgggaaggcgaagggcucccgcgccaucugguacauguggcucggcgcccgguuccuggaguucgaggcccugggguucaugaacgaggaccacugguucagccgcgagaacucccucagcggcgucgagggggagggccugcacaagcugggguacauccuccgggacaucuccaagaucccgggcggcaacauguacgccgacgacaccgcggggugggacacccgcaucacggaggacgaccugcagaacgaggccaagaucaccgacaucauggagcccgagcacgcccugcucgccaccagcaucuucaagcugaccuaccagaacaagguggugcggguccagcgccccgccaagaacggcacggugauggacgugaucucccgccgggaccagcgcgggagcggccaggucggcaccuacgggcugaacaccuucaccaacauggaggugcagcucauccggcagauggaguccgagggcaucuucuuccccagcgagcuggaguccccgaaccuggcggagcgcgugcucgacuggcuggagaagcacggggccgagcggcugaagcgcauggccaucagcggcgacgacugcgucgugaagcccaucgacgaccgguucgccacggcccucaucgcgcugaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcucgucgggcgggcccgcgugucccagggcgccggguggagccugcgggagaccgccugccugggcaaguccuacgcccagauguggcagcucauguacuuccaccgccgggaccugcgccuggcggccaacgccaucugcagcgccgugcccgucgacugggugcccaccagccggaccaccugguccauccacgcgcaccaccaguggaugacgaccgaggacaugcucagcguguggaaccgcgucuggaucgaggagaacccguggauggaggacaagacccacguguccagcugggaggaggugcccuaccuggggaagcgggaggaccaguggugcggcucccugaucggccucaccgcccgcgccacgugggccaccaacauccaggucgccaucaaccaggugcgccggcugaucgggaacgagaacuaccuggacuacaugaccagcaugaagcgcuucaagaacgaguccgaccccgagggcgcgcucugguga

SEQ ID NO: 7930 - RNA, 9879 nt, Artificial Sequence
  derived and/or modified CDS sequence (opt1) from DENV-1__JX669469__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacccgcaccgagaccuggaugagcuccgagggcgccuggaagcagauccagaaggucgagaccugggcccugcggcacccgggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucaaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgagcagcgcgccuggaacaucugggaggucgaggacuacggcuucgggaucuucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagauguacgggggcccgaucucccagcacaacuaccgccccggguacuucacccagaccgccggccccuggcaccuggggaagcucgagcuggacuucgaccugugcgagggcacgaccgugguggucgacgagcacugcggcagccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucguccgguccauggugagcgccggcagcggcgagguggacuccuucagccuggggauccugugcgucuccaucaugaucgaggaggugaugcgcagccgguggucccgcaagaugcucaugaccggcacgcuggccguguuccugcuccugaucauggcccagcugaccuggaacgaccucauccgccugugcaucauggucggggcgaacgccagcgacaagaugggcauggggaccaccuaccuggcccucauggccacguucaagaugcggccgauguucgccguggggcugcuguuccgccggcucaccucccgcgaggugcugcugcucaccaucggccugagccuggucgcguccguggagcuccccaacagccuggaggagcugggggacggccucgccauggggaucaugaugcugaagcugcucaccgaguuccagccccaccagcuguggacgacccugcucucccugaccuucaucaagaccacgcugagccucgacuacgccuggaagaccaccgccaugguccuguccaucgugagccuguucccccucugccuguccaccacgagccagaagaccaccuggcugccggugcuccugggcuccuucggcugcaagccccugaccauguuccucaucaccgagaacgagaucugggggcgcaagagcuggccccugaacgagggcaucauggcgaucgggaucgucuccauccugcucagcagccugcugaagaacgacgugccccucgccggcccgcugaucgccgggggcaugcugaucgccugcuacgugaucuccggcagcuccgccgaccucagccuggagaaggcggccgaggucuccugggaggaggaggccgagcacagcgggacgucccacaacauccugguggaggugcaggacgacggcaccaugaagaucaaggacgaggagcgcgacgacacccucaccauccugcugaaggccacgcuccuggccgucagcgggguguaccccauguccauccccgcgacccuguucgugugguacuucuggcagaagaagaagcagcggagcggcguccucugggacacccccuccccgcccgagguggagcgcgccgugcuggacgacgggaucuaccggauccugcagcgcggccugcucggccggagccaggucggggugggcguguuccaggacggggucuuccacaccauguggcacgugacgcgcggcgccgugcugauguaccaggggaagcggcuggagcccuccugggccagcgucaagaaggaccucaucuccuacggcggcggguggcgcuuccagggcagcuggaacaccggggaggagguccaggugaucgccgucgagcccggcaagaacccgaagaacgugcagaccacccccgggacguucaagacccccgagggcgaggugggcgcgaucgcccuggacuucaagcccgggaccuccggcagcccgaucgucaaccgggaggggaagaucgugggccuguacggcaacgggguggucaccacguccggcaccuacgugagcgccaucgcccaggccaaggcgagccaggaggggccccuccccgagaucgaggacgagguguucaagaagcgcaaccugaccaucauggaccugcacccgggcuccgggaagacccggcgcuaccuccccgccaucguccgggaggccaucaagcgcaagcugcggacgcugauccucgcccccacccgcgugguggcgagcgagauggccgaggcccugaagggcaugcccauccgcuaccagaccaccgccgucaaguccgagcacacgggccgggagaucguggaccugaugugccacgccaccuucaccaugcgccuccugagcccggugcggguccccaacuacaacaugaucaucauggacgaggcgcacuucaccgaccccgccuccaucgccgcccgcggguacaucagcacgcgggugggcaugggggaggccgcggccaucuucaugaccgccacgccgcccggcuccguggaggccuucccccagagcaacgccgucauccaggacgaggagcgcgacauccccgagcgguccuggaacagcggguacgacuggaucaccgacuuccccggcaagacggugugguucgugcccuccaucaagagcggcaacgacaucgcgaacugccugcgcaagaacgggaagcgggucauccagcucucccgcaagaccuucgacaccgaguaccagaagaccaagaacaacgacugggacuacguggugacgaccgacaucagcgagaugggcgccaacuuccgggccgaccgcgucaucgacccccggcgcugccugaagcccgugauccugaaggacgggcccgagcgggugauccucgccggcccgaugcccgucaccguggcguccgccgcccagcgccgggggcgcaucggccggaaccagaacaaggagggcgaccaguacgucuacauggggcagccccugaacaacgacgaggaccacgcccacuggaccgaggccaagaugcugcucgacaacaucaacacgcccgagggcaucaucccggcgcuguucgagcccgagcgcgagaaguccgccgccaucgacggggaguaccgccugcggggcgaggcccgcaagaccuucguggagcucaugcggcgcggggaccugcccguguggcuguccuacaaggucgccagcgagggcuuccaguacuccgaccggcgcuggugcuucgacggcgagcggaacaaccaggugcucgaggagaacauggacguggagaucuggaccaaggagggggagcgcaagaagcugcggccccgcuggcuggacgcgcggaccuacagcgacccgcucgcccugcgcgaguucaaggaguucgccgccggccggcgcagcgucuccggggaccugauccucgagaucggcaagcugccccagcaccugacccuccgggcccagaacgcgcuggacaaccuggugaugcuccacaacagcgagcagggcgggaaggccuaccgccacgccauggaggagcugcccgacacgaucgagacccugaugcuccuggcccugaucgcggugcucaccggcggggucacccuguucuuccuguccggcaaggggcucggcaagacgagcaucggccugcugugcgugaccgccuccagcgcccuccuguggauggccuccguggagccccacuggaucgccgcgagcaucauccuggaguucuuccucaugguccugcugaucccggagcccgaccggcagcgcacgccccaggacaaccagcucgccuacguggugaucgggcugcuguucaugauccucaccgucgccgccaacgagaugggccugcuggagacgaccaagaaggaccucgggaucggccacguggccgcggagaaccaccagcacgccaccauccuggacguggaccugcacccggccuccgccuggacccucuacgccgucgcgacgaccgugaucacccccaugaugcggcacaccaucgagaacacgaccgccaacaucagccugaccgccaucgccaaccaggccgcgauccugauggggcucgacaagggcuggcccaucuccaagauggaccugggcgugccccugcucgcccuggggugcuacagccaggucaacccgcugacccucacggccgccgugcugaugcugguggcgcacuacgccaucaucggccccgggcuccaggccaaggccacccgcgaggcccagaagcggaccgcggccggcaucaugaagaaccccaccgucgacgggaucguggccaucgaccuggaccccguggucuacgacgccaaguucgagaagcagcugggccagaucaugcuccugauccugugcacgucccagauccuccugaugcgcaccaccugggcccugugcgagagcaucacccucgcgacgggcccgcugaccacccugugggaggggucccccggcaaguucuggaacaccacgaucgccgugagcauggccaacaucuuccgcggguccuaccucgccggcgccggccuggcguucagccugaugaagucccucgggggcgggcggcgcggcaccggggcccagggcgagacccugggcgagaaguggaagcggcagcugaaccagcucagcaagagcgaguucaacaccuacaagcgcuccgggaucauggagguggaccggagcgaggccaaggagggccugaagcgcggggagacgaccaagcacgccgucucccggggcaccgcgaagcugcgcugguucguggagcggaaccuggugaagcccgaggggaaggucaucgaccucggcugcggccgcgggggcuggagcuacuacugcgccgggcugaagaaggugaccgaggugaagggcuacaccaagggcgggcccggccacgaggagccgauccccauggccacguacggguggaaccuggucaagcuccacuccggcaaggacguguucuucaugccgcccgagaagugcgacacccugcugugcgacaucggggagagcuccccgaaccccaccaucgaggagggccggacccuccgcgugcugaagauggucgagcccuggcugcgggggaaccaguucugcaucaagauccucaaccccuacaugccgagcgugguggagacgcuggagcagaugcagcgcaagcacggcggcaugcugguccggaacccccucucccgcaacagcacccacgagauguacuggguguccugcgggaccggcaacaucgugagcgccgucaacaugaccucccggaugcugcugaaccgcuucacgauggcccaccggaagcccaccuacgagcgcgacguggaccucggggcgggcacccgccacguggccgucgagcccgagguggccaaccuggacaucaucggccagcggaucgagaacaucaagaacgagcacaagagcaccuggcacuacgacgaggacaacccguacaagacgugggccuaccacggguccuacgaggugaagcccagcggcuccgccagcuccauggucaacggggugguccgccugcucaccaagcccugggacgugauccccauggugacccagaucgcgaugaccgacacgaccccguucggccagcagcgggucuucaaggagaagguggacacccgcacgccccgggccaagcgcgggacggcccagaucauggaggugaccgccaaguggcuguggggcuuccugagccggaacaagaagccccgcaucugcacccgggaggaguucacccgcaagguccggagcaacgccgcgaucggcgccguguucguggacgagaaccaguggaacuccgccaaggaggccgucgaggacgagcgcuucugggaccucgugcaccgggagcgcgagcugcacaagcaggggaagugcgcgacgugcguguacaacaugaugggcaagcgggagaagaagcugggggaguucggcaaggccaaggggagccgcgccaucugguacauguggcucggcgcccgguuccuggaguucgaggcccugggcuucaugaacgaggaccacugguucucccgcgagaacagccucuccggggucgagggcgaggggcugcacaagcugggcuacauccuccgggacaucagcaagauccccggcgggaacauguacgcggacgacaccgccgggugggacacccgcaucaccgaggacgaccugcagaacgaggccaagaucacggacaucauggagcccgagcacgcccugcucgccaccuccaucuucaagcugaccuaccagaacaagguggugcggguccagcgccccgcgaagaacgggaccgugauggacgugaucagccgccgggaccagcgcggcuccgggcaggucggcacguacggccugaacaccuucaccaacauggaggugcagcucauccggcagauggagagcgaggggaucuucuuccccuccgagcuggagagcccgaaccuggccgagcgcgugcucgacuggcuggagaagcacggcgccgagcggcugaagcgcauggccaucuccggggacgacugcgucgugaagcccaucgacgaccgguucgccaccgcgcucaucgcccugaacgacaugggcaaggugcgcaaggacaucccccagugggagcccagcaagggguggaacgacuggcagcaggucccguucugcucccaccacuuccaccagcugaucaugaaggacggccgggagaucguggugcccugccgcaaccaggacgagcucgucggccgggcccgcgugagccagggggccggcuggucccugcgggagacggccugccugggcaagagcuacgcgcagauguggcagcucauguacuuccaccgccgggaccugcgccuggccgccaacgccaucugcagcgcggugcccgucgacugggugcccaccucccggaccaccuggagcauccacgcccaccaccaguggaugaccacggaggacaugcucuccguguggaaccgcgucuggaucgaggagaacccguggauggaggacaagacccacgugagcuccugggaggaggugcccuaccugggcaagcgggaggaccaguggugcgggagccugaucggccucaccgcccgcgccaccugggccacgaacauccaggucgcgaucaaccaggugcgccggcugaucggcaacgagaacuaccuggacuacaugaccuccaugaagcgcuucaagaacgagagcgaccccgagggggcccucugguga

SEQ ID NO: 7931 - RNA, 9879 nt, Artificial Sequence
  derived and/or modified CDS sequence (opt1) from DENV-1__JX669470__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacccggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgugguggggauggucacccuguaccucggcgugauggugcaggccgacagcgggugcgucaucaacuggaagggccgcgagcugaagugcggguccggcaucuucgugacgaacgaggugcacaccuggaccgagcaguacaaguuccaggccgacagcccgaagcggcugagcgccgcgaucggccgcgccugggaggagggggucugcggcauccgguccgccacccgccucgagaacaucauguggaagcagaucagcaacgagcugaaccacauccugcucgagaacgacaucaaguucaccgugguggucgggaacgccaacggcauccuggcccaggggaagaagaugauccggccccagcccauggagcacaaguacuccuggaaguccuggggcaaggcgaagaucaucggcgccgacauccagaacacgaccuucaucaucgacgggcccgacaccccggagugccccgacgagcagcgcgccuggaacaucugggagguggaggacuacggcuucgggaucuucaccacgaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagaccugcaucuggcccaagagccacacgcucugguccaacggcgugcuggagagcgagaugaucauccccaagauguacgggggcccgaucucccagcacaacuaccgccccggguacuucacccagaccgcgggccccuggcaccuggggaagcucgagcuggacuucgaccugugcgagggcaccacgguggucguggacgagcacugcggcagccgggggccgucccuccgcaccaccaccgugacgggcaagaucauccacgaguggugcugccggagcugcacccugccgccccugcgcuuccgcggggaggacggcugcugguacgggauggagauccgccccgucaaggagaaggaggagaaccucgugcgguccauggugagcgccggcagcggcgaggucgacuccuucagccuggggauccugugcguguccaucaugaucgaggaggugaugcgcagccgguggucccgcaagaugcucaugaccggcacccuggccgucuuccugcuccugaucauggggcagcugacguggaacgaccucauccgccugugcaucauggugggcgccaacgccagcgacaagauggggaugggcaccaccuaccuggcgcucauggccaccuucaagaugcggccgauguucgccguggggcugcuguuccgccggcucacgucccgcgagguccugcugcucaccaucgggcugagccugguggccuccgucgagcuccccaacagccuggaggagcugggcgacgggcucgccaugggcaucaugaugcugaagcugcucaccgaguuccagccccaccagcuguggaccacgcugcucucccugaccuucaucaagaccacccugagccucgacuacgcguggaagacgaccgccauggugcuguccaucgugagccuguucccccucugccuguccaccaccagccagaagacgaccuggcugccgguccuccugggcuccuucgggugcaagccccugaccauguuccucaucaccgagaacgagaucuggggccgcaagagcuggccccugaacgaggggaucauggccgugggcaucguguccauccugcucagcagccugcugaagaacgacgucccccucgccgggccgcugaucgcgggcggcaugcugaucgccugcuacgugaucuccgggagcuccgccgaccucagccuggagaaggccgccgagguguccugggaggaggaggcggagcacagcggcaccucccacaacauccuggucgaggugcaggacgacgggacgaugaagaucaaggacgaggagcgcgacgacacccucaccauccugcugaaggccacccuccuggccgugagcggcgucuaccccauguccauccccgccacgcuguucgugugguaccucuggcagaagaagaagcagcggagcggggugcugugggacacccccuccccgcccgaggucgagcgcgccgugcuggacgacggcaucuaccggauccugcagcgcggccuccuggggcggagccaggugggcgucgggguguuccaggacggcguguuccacaccauguggcacgucacccgcggggcggugcugauguaccagggcaagcggcucgagcccuccugggccagcgugaagaaggaccugaucuccuacggcgggggcuggcgcuuccaggggagcuggaacacgggcgaggagguccaggugaucgccguggagcccgggaagaacccgaagaacguccagaccacccccggcaccuucaagacgcccgagggcgaggugggggccaucgcccuggacuucaagcccggcaccuccgggagcccgaucgugaaccgggagggcaagaucgucggccucuacgggaacggcguggugaccaccuccgggacguacgucagcgcgaucgcccaggccaaggccagccaggagggcccccugcccgagaucgaggacgagguguucaagaagcgcaaccugaccaucauggaccuccacccgggguccggcaagacccggcgcuaccugcccgccaucgugcgggaggcgaucaagcgcaagcugcggacccucauccuggcccccacgcgcgucguggccagcgagauggccgaggcgcugaagggcaugcccauccgcuaccagaccaccgccgugaaguccgagcacaccgggcgggagaucgucgaccucaugugccacgccacguucaccaugcgccugcugagcccggugcgggugcccaacuacaacaugaucaucauggacgaggcccacuucaccgaccccgccuccaucgcggcccgcggcuacaucagcacccgggucgggaugggcgaggccgccgccaucuucaugacggcgacgccgcccggguccguggaggccuucccccagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccuccgcaagaacggcaagcgggugauccagcugucccgcaagacguucgacaccgaguaccagaagaccaagaacaacgacugggacuacgucgugaccacggacaucagcgagaugggggccaacuuccgggcggaccgcgugaucgacccccggcgcugccugaagcccgucauccucaaggacggccccgagcgggugauccuggccgggccgaugcccgucaccguggccuccgccgcgcagcgccggggccgcaucggccggaaccagaacaaggagggggaccaguacguguacaugggccagccccugaacaacgacgaggaccacgcccacuggaccgaggccaagaugcuccuggacaacaucaacacccccgaggggaucaucccggcccuguucgagcccgagcgcgagaaguccgccgcgaucgacggcgaguaccgccuccgcggggaggcccgcaagacguucgucgagcugaugcggcgcggcgaccugcccguguggcucuccuacaagguggccagcgagggcuuccaguacuccgaccggcgcuggugcuucgacggggagcggaacaaccagguccuggaggagaacauggacguggagaucuggaccaaggagggcgagcgcaagaagcugcggccccgcuggcucgacgcccggaccuacagcgacccgcuggcccugcgcgaguucaaggaguucgcggccgggcggcgcagcguguccggcgaccucauccuggagaucggcaagcugccccagcaccucacccugcgggcccagaacgcccuggacaaccucgucaugcugcacaacagcgagcagggcgggaaggccuaccgccacgcgauggaggagcugcccgacaccaucgagacgcucaugcugcuggcccucaucgccgugcugaccgggggcgugacccuguucuuccucuccgggaagggccugggcaagaccagcaucgggcugcucugcgucacggccuccagcgcgcugcuguggauggccuccguggagccccacuggaucgccgccagcaucauccucgaguucuuccugauggugcugcucaucccggagcccgaccggcagcgcacgccccaggacaaccagcuggccuacgucgugaucggccuccucuucaugauccugaccguggcggccaacgagauggggcugcucgagaccacgaagaaggaccugggcaucgggcacgucgccgccgagaaccaccagcacgccaccaugcuggacguggaccuccacccggcguccgccuggacccuguacgccguggccaccacggucaucacccccaugaugcggcacaccaucgagaacaccacggccaacaucagccugaccgcgaucgccaaccaggccgccauccucaugggccuggacaagggcuggcccaucuccaagauggaccugggggugccccuccuggcccugggcugcuacagccaggugaacccgcucacccugaccgcggccguccugaugcucguggcccacuacgccaucaucgggcccggccugcaggcgaaggccacgcgcgaggcccagaagcggaccgccgccgggaucaugaagaaccccaccguggacggcaucgucgcgaucgaccuggaccccgugguguacgacgccaaguucgagaagcagcucggccagaucaugcugcugauccucugcaccucccagauccugcugaugcgcacgaccugggcccucugcgagagcaucacccuggccaccgggccgcugacgacccucugggagggcucccccgggaaguucuggaacaccaccaucgccgucagcauggcgaacaucuuccgcggcuccuaccuggccggcgccgggcuggccuucagccucaugaagucccugggcgggggccggcgcgggacgggcgcccagggcgagacccugggggagaaguggaagcggcagcucaaccagcugagcaagagcgaguucaacaccuacaagcgcuccggcaucauggagguggaccggagcgaggcgaaggaggggcugaagcgcggcgagaccacgaagcacgccgugucccgggggaccgccaagcugcgcugguucgucgagcggaaccucgugaagcccgagggcaaggugaucgaccugggcugcgggcgcggcggguggagcuacuacugcgccggccugaagaaggucaccgaggugaagggguacaccaagggcggccccgggcacgaggagccgauccccauggcgaccuacggcuggaaccucgugaagcugcacuccgggaaggacgucuucuucaugccgcccgagaagugcgacacgcugcucugcgacaucggcgagagcuccccgaaccccaccaucgaggaggggcggacccugcgcgugcugaagaugguggagcccuggcuccggggcaaccaguucugcaucaagauccugaaccccuacaugccgagcgucguggagacccuggagcagaugcagcgcaagcacggcgggaugcucgugcggaacccccugucccgcaacagcacgcacgagauguacugggucuccugcggcaccgggaacaucgugagcgccgugaacaugaccucccggaugcugcucaaccgcuucaccauggcccaccggaagcccacguacgagcgcgacgucgaccugggcgccggcacccgccacguggccguggagcccgaggucgcgaaccuggacaucaucgggcagcggaucgagaacaucaagaacgagcacaagagcaccuggcacuacgacgaggacaacccguacaagaccugggccuaccacggcuccuacgaggugaagcccagcggguccgccagcuccauggucaacggcguggugcgccuccugacgaagcccugggacgucauccccauggugacccagaucgccaugaccgacaccacgccguucgggcagcagcggguguucaaggagaaggucgacacccgcacgccccgggccaagcgcggcaccgcgcagaucauggaggugacggccaaguggcuguggggcuuccucagccggaacaagaagccccgcaucugcacccgggaggaguucacccgcaaggugcggagcaacgccgccaucggggccgucuucguggacgagaaccaguggaacuccgcgaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagaucccgggcggcaacauguacgccgacgacacggccgggugggacacccgcaucaccgaggacgaccugcggaacgaggcgaagaucaccgacaucauggagcccgagcacgcccuccuggccacguccaucuucaagcugaccuaccagaacaaggucgugcgcgugcagcgccccgccaagaacggcaccgucauggacgugaucagccggcgcgaccagcggggguccggccaggugggcaccuacgggcucaacacguucaccaacauggagguccagcugauccgccagauggagagcgagggcaucuucuuccccuccgagcuggagagcccgaaccucgccgagcgggugcuggacuggcuggagaagcacggggcggagcgccucaagcggauggccaucuccggcgacgacugcguggucaagcccaucgacgaccgcuucgccaccgcccugaucgcccugaacgacauggggaaggugcggaaggacaucccccagugggagcccagcaagggcuggaacgacuggcagcaggucccguucugcucccaccacuuccaccagcucaucaugaaggacggccgcgagaucgucgugcccugccggaaccaggacgagcugguggggcgcgcgcgggucagccagggcgccggguggucccugcgcgagaccgccugccucggcaagagcuacgcccagauguggcagcugauguacuuccaccggcgcgaccugcggcucgccgcgaacgccaucugcagcgccgugcccguggacuggguccccacgucccgcaccaccuggagcauccacgcccaccaccaguggaugaccaccgaggacaugcuguccguguggaaccggguguggaucgaggagaacccguggauggaggacaagacgcacgucagcuccugggaggaggugcccuaccuggggaagcgcgaggaccaguggugcggcagccucaucggccugaccgcgcgcgccaccugggccaccaacauccagguggccaucaaccagguccggcgccugaucgggaacgagaacuaccucgacuacaugacguccaugaagcgguucaagaacgagagcgaccccgagggcgcccugugguga

SEQ ID NO: 7932 - RNA, 9879 nt, Artificial Sequence
  derived and/or modified CDS sequence (opt1) from DENV-1__JX669471__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcgguccguggcccuggcgccccacgugggccuggggcucgagacccggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacgagcagcgcgccuggaacaucugggaggucgaggacuacggcuucgggaucuucacgaccaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagacgugcaucuggcccaagagccacacccucugguccaacggcguccuggagagcgagaugaucauccccaagauguacgggggcccgaucucccagcacaacuaccgccccggguacuucacccagaccgccggccccuggcaccuggggaagcucgagcuggacuucgaccugugcgagggcacgaccgugguggucgacgagcacugcggcagccgggggccgucccuccgcaccaccacggugaccggcaagaucauccacgaguggugcugccggagcugcacccugccgccccugcgcuuccgcggggaggacggcugcugguacgggauggagauccgccccgugaaggagaaggaggagaaccucguccgguccauggugagcgccggcagcggcgagguggacuccuucagccuggggauccugugcgucuccaucaugaucgaggaggugaugcgcagccgguggucccgcaagaugcucaugaccggcacgcuggccguguuccugcuccugaucauggggcagcugaccuggaacgaccucauccgccugugcaucauggucggcgccaacgcgagcgacaagauggggaugggcaccaccuaccuggcccucauggccacgcugaagaugcggccgauguucgccguggggcuccucuuccgccggcugaccucccgcgaggugcugcuccugaccaucgggcugagccucgucgccuccguggagcugcccaacagccuggaggagcucggcgacgggcuggcgaugggcaucaugaugcugaagcuccugaccgaguuccagccccaccagcuguggacgacccuccugucccugaccuucaucaagaccacgcucagccuggacuacgccuggaagaccaccgccaugguccuguccaucgugagccucuucccccugugccuguccaccacgagccagaagaccaccuggcucccggugcugcugggcuccuucgggugcaagccccucaccauguuccugaucaccgagaacgagaucuggggccgcaagagcuggccccugaacgaggggaucauggccaucggcaucgucuccauccuccugagcagccugcucaagaacgacgugccccuggcggggccgcugaucgccggcggcaugcucaucgccugcuacgugaucuccgggagcuccgccgaccugagccuggagaaggccgcggaggucuccugggaggaggaggccgagcacagcggcacgucccacaacauccucguggaggugcaggacgacgggaccaugaagaucaaggacgaggagcgcgacgacacccugaccauccugcucaaggccacgcugcuggccgucagcggcguguaccccauguccauccccgccacccucuucgugugguacuucuggcagaagaagaagcagcggagcgggguccugugggacacccccuccccgcccgagguggagcgcgcggugcuggacgacggcaucuaccggauccugcagcgcggccuccuggggcggagccaggucggcguggggguguuccaggacggcgucuuccacaccauguggcacgugacgcgcggggccgugcugauguaccagggcaagcggcucgagcccuccugggccagcgucaagaaggaccugaucuccuacggcgggggcuggcgcuuccaggggagcuggaacaccggcgaggagguccaggugaucgccgucgagcccgggaagaacccgaagaacgugcagaccacccccggcacguucaagacccccgagggcgaggugggggccaucgcgcuggacuucaagcccggcaccuccgggagcccgaucgucaaccgggagggcaagaucgugggccucuacgggaacggcguggucaccacguccgggaccuacgugagcgccaucgcccaggccaaggccagccaggagggcccccugcccgagaucgaggacgagguguucaagaagcgcaaccugaccaucauggaccuccacccgggguccggcaagacccggcgcuaccugcccgcgaucguccgggaggccaucaagcgcaagcugcggacgcucauccuggcccccacccgcgugguggccagcgagauggcggaggcccugaagggcaugcccauccgcuaccagaccaccgccgucaaguccgagcacacggggcgggagaucguggaccucaugugccacgccaccuucaccaugcgccugcugagcccggugcggguccccaacuacaacaugaucaucauggacgaggcccacuucaccgugcccgcguccaucgccgcccgcggcuacaucagcacgcggguggggaugggcgaggccgccgcgaucuucaugaccgccacgccgcccggguccgucgaggccuucccccagagcaacgccgugauccaggacgaggagcgcgacauccccgagcgguccuggaacagcggcuacgacuggaucaccgacuuccccggcaagacggugugguucguccccuccaucaagagcgggaacgacaucgccaacugccuccgcaagaacggcaagcgggugauccagcugucccgcaagaccuucgacaccgaguaccagaagaccaagaacaacgacugggacuacguggucacgaccgacaucagcgagaugggggcgaacuuccgggccgaccgcgugaucgacccccggcgcugccugaagcccgugauccucaaggacggccccgagcgggucauccuggccgggccgaugcccgugaccgucgccuccgcggcccagcgccggggccgcaucggccggaaccagaacaaggagggggaccaguacguguacaugggccagccccugaacaacgacgaggaccacgcccacuggaccgaggccaagaugcuccuggacaacaucaacacgcccgaggggaucaucccggcccuguucgagcccgagcgcgagaaguccgcggccaucgacggcgaguaccgccuccgcggggaggcccgcaagaccuucguggagcugaugcggcgcggcgaccugcccgucuggcucuccuacaagguggccagcgagggcuuccaguacuccgaccggcgcuggugcuucgacggggagcggaacaaccaggugcuggaggagaacauggacgucgagaucuggaccaaggagggcgagcgcaagaagcugcggccccgcuggcucgacgcccggaccuacagcgacccgcuggcgcugcgcgaguucaaggaguucgccgccgggcggcgcagcguguccggcgaccucauccuggagaucggcaagcugccccagcaccucacccagcgggcccagaacgcccuggacaaccuggugaugcuccacaacagcgagcagggcgggaaggcguaccgccacgccauggaggagcugcccgacacgaucgagacccugaugcuccuggcccugaucgccguccucaccgggggcgugacccuguucuuccuguccgggaagggccucggcaagacgagcaucgggcugcugugcgugaccgcguccagcgcccuccuguggauggccuccgucgagccccacuggaucgccgccagcaucauccuggaguucuuccucauggugcugcugaucccggagcccgaccggcagcgcacgccccaggacaaccagcucgcguacguggucaucggccugcuguucaugauccucaccguggccgccaacgagauggggcugcuggagacgaccaagaaggaccucggcaucgggcacguggccgccgagaaccaccagcacgcgaccaugcuggacgucgaccugcacccggccuccgccuggacccucuacgccguggccacgaccgugaucacccccaugaugcggcacaccaucgagaacacgaccgcgaacaucagccugaccgccaucgccaaccaggccgccauccugaugggccucgacaagggcuggcccaucuccaagauggaccugggggucccccugcucgcgcugggcugcuacagccaggugaacccgcugacccucacggccgccgugcugaugcuggucgcccacuacgcgaucaucgggcccggccuccaggccaaggccacccgcgaggcccagaagcggaccgccgcggggaucaugaagaaccccaccguggacggcaucguggccaucgaccuggaccccgucguguacgacgccaaguucgagaagcagcugggccagaucaugcuccugauccugugcacgucccagauccuccugaugcgcaccaccugggcccugugcgagagcaucacccucgccacggggccgcugaccacccugugggagggcucccccgggaaguucuggaacaccacgaucgcggugagcauggccaacaucuuccgcggcuccuaccucgccggcgccgggcuggccuucagccugaugaagucccucggcgggggccggcgcgggaccggcgcgcagggcgagacccugggggagaaguggaagcggcagcugaaccagcucagcaagagcgaguucaacaccuacaagcgcuccggcaucauggaggucgaccggagcgaggccaaggaggggcugaagcgcggcgagacgaccaagcacgccgugucccgggggaccgccaagcugcgcugguucguggagcggaaccuggucaagcccgagggcaaggugaucgaccucggcugcgggcgcggcggguggagcuacuacugcgcgggccugaagaaggugaccgaggucaagggguacaccaagggcggccccgggcacgaggagccgauccccauggccacguacggcuggaaccuggugaagcuccacuccgggaaggacguguucuucaugccgcccgagaagugcgacacccugcugugcgacaucggcgagagcuccccgaaccccaccaucgaggaggggcggacccuccgcguccugaagaugguggagcccuggcugcggggcaaccaguucugcaucaagauccucaaccccuacaugccgagcguggucgagacgcuggagcagaugcagcgcaagcacggcgggaugcuggugcggaacccccucucccgcaacagcacccacgagauguacuggguguccugcggcaccgggaacaucgucagcgccgugaacaugaccucccggaugcugcugaaccgcuucacgauggcccaccggaagcccaccuacgaccgcgacguggaccucggcgccggcacccgccacgucgcgguggagcccgagguggccaaccuggacaucaucgggcagcggaucgagaacaucaagaacgagcacaagagcaccuggcacuacgacgaggacaacccguacaagacgugggccuaccacggcuccuacgaggucaagcccagcggguccgccagcuccauggugaacggcgucgugcgccugcucaccaagcccugggacgugauccccauggucacccagaucgccaugaccgacacgaccccguucgggcagcagcggguguucaaggagaagguggacacccgcacgccccgggcgaagcgcggcacggcccagaucauggaggucaccgccaaguggcuguggggcuuccugagccggaacaagaagccccgcaucugcacccgggaggaguucacccgcaaggugcggagcaacgccgccaucggggcgguguucgucgacgagaaccaguggaacuccgccaaggaggccguggaggacgagcgcuucugggaccucgugcaccgggagcgcgagcugcacaagcagggcaagugcgccacgugcgucuacaacaugauggggaagcgggagaagaagcugggcgaguucgggaaggcgaagggcagccgcgccaucugguacauguggcucggcgcccgguuccuggaguucgaggcccugggguucaugaacgaggaccacugguucucccgcgagaacagccucuccggcguggagggggagggccugcacaagcugggguacauccuccgggacaucagcaagaucccgggcggcaacauguacgccgacgacaccgcggggugggacacccgcaucaccgaggacgaccugcagaacgaggccaagaucacggacaucauggagcccgagcacgcccugcucgccaccuccaucuucaagcugaccuaccagaacaaggugguccgggugcagcgccccgccaagaacggcaccgugauggacgucaucagccgccgggaccagcgcggguccggccaggugggcacguacgggcugaacaccuucaccaacauggaggugcagcucauccggcagauggagagcgagggcaucuucuuccccuccgagcuggagagcccgaaccuggcggagcgcguccucgacuggcuggagaagcacggggccgagcggcugaagcgcauggccaucuccggcgacgacugcguggugaagcccaucgacgaccgguucgccaccgcccucaucgcgcugaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcucguggggcgggcccgcgugagccagggcgccggguggucccugcgggagacggccugccugggcaagagcuacgcccagauguggcagcucauguacuuccaccgccgggaccugcgccuggcggccaacgccaucugcagcgccguccccguggacugggugcccaccucccggaccaccuggagcauccacgcgcaccaccaguggaugaccacggaggacaugcucuccgucuggaaccgcguguggaucgaggagaacccguggauggaggacaagacccacgugagcuccugggaggagguccccuaccuggggaagcgggaggaccaguggugcggcagccugaucggccucaccgcccgcgccaccugggccacgaacauccagguggccaucaaccaggugcgccggcugaucgggaacgagaacuaccuggacuacaugaccuccaugaagcgcuucaagaacgagagcgaccccgagggcgcgcucugguga

SEQ ID NO: 7933 - RNA, 9879 nt, Artificial Sequence
  derived and/or modified CDS sequence (opt1) from DENV-1__JX669472__SS-prME
agcgugaccaugcugcucaugcugcugcccaccgcccucgccuuccaccugaccacccggggcggggagccccacaugaucgugagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaugaaguucacggucgugguggggaacgccaacggcauccuggcgcaggggaagaagaugaucaagccccagcccauggagcacaaguacuccuggaaguccuggggcaaggccaagaucaucggcgccgacauccagaacaccaccuucaucaucgacgggcccgacaccccggagugccccgacgagcagcgggccuggaacaucugggaggucgaggacuacggcuucgggaucuucacgaccaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagacgugcaucuggcccaagagccacacccucugguccaacggcguccuggagagcgagaugaucauccccaagauguacgggggcccgaucucccagcacaacuaccggcccggguacuucacccagaccgccggccccuggcaccuggggaagcucgagcuggacuucgaccugugcgagggcacgaccgugguggucgacgagcacugcggcagccgcgggccgucccuccggaccaccacggugaccggcaagaucauccacgaguggugcugccgcagcugcacccugccgccccugcgguuccgcggggaggacggcugcugguacgggauggagauccggcccgugaaggagaaggaggagaaccucguccgcuccauggugagcgccggcagcggcgagguggacuccuucagccuggggauccugugcgucuccaucaugaucgaggaggugaugcggagccgcuggucccggaagaugcucaugaccggcacgcuggccguguuccugcuccugaucauggggcagcugaccuggaacgaccucauccgccugugcaucauggucggcgccaacgcgagcgacaagauggggaugggcaccaccuaccuggcccucauggccacguucaagaugcgcccgauguucgccguggggcugcuguuccggcgccucaccucccgggaggugcugcugcucaccaucgggcugagccuggucgccuccguggagcuccccaacagccuggaggagcugggcgacgggcucgcgaugggcaucaugaugcugaagcugcucaccgaguuccagccccaccagcuguggacgacccugcucucccugaccuucaucaagaccacgcugagccucgacuacgccuggaagaccaccgccaccguccuguccaucgugagccuguucccccucugccuguccacgaccagccagaagaccaccuggcugccggugcuccugggcuccuucgggugcaagccccugaccauguuccucaucacggagaacaagaucuggggccgcaagagcuggccccugaacgaggggaucauggccaucggcaucgucuccauccugcucagcagccugcugaagaacgacgugccccucgcggggccgcugaucgccggcggcaugcugaucgccugcuacgugaucuccgggagcuccgccgaccucagccuggagaaggccgcggaggucuccugggaggaggaggccgagcacagcggcaccucccacaacauccugguggaggugcaggacgacgggaccaugaagaucaaggacgaggagcgggacgacacccucacgauccugcugaaggccacccuccuggccgucagcggcguguaccccauguccauccccgccacccuguucgugugguacuucuggcagaagaagaagcagcgcagcgggguccucugggacacccccuccccgcccgagguggagcgggcggugcuggacgacggcaucuaccgcauccugcagcggggccugcucgggcgcagccaggucggcguggggguguuccaggacggcgucuuccacacgauguggcacgugacccgcggggccgugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaacccgaagaacgugcagaccacgcccggcaccuucaagacccccgagggcgaggugggggccaucgcgcuggacuucaagcccggcaccuccgggagcccgaucgucaaccgcgagggcaagaucgugggccuguacgggaacggcguggucacgaccuccgggaccuacgugagcgccaucgcccaggccaaggccagccaggagggcccccuccccgagaucgaggacgagguguucaagaagcggaaccugaccaucauggaccugcacccgggguccggcaagacgcgccgguaccuccccgcgaucguccgcgaggccaucaagcggaagcugcgcacccugauccucgcccccacccgggugguggccagcgagauggcggaggcccugaagggcaugcccauccgcuaccagaccacggccgucaaguccgagcacaccgggcgcgagaucguggaccugaugugccacgccaccuucaccaugcggcuccugagcccggugcgcguccccaacuacaacaugaucaucauggacgaggcccacuucacggaccccgcguccaucgccgcccggggcuacaucagcacccgcguggggaugggcgaggccgccgcgaucuucaugaccgccacgccgcccggguccguggaggccuucccccagagcaacgccgucauccaggacgaggagcgggacauccccgagcgcuccuggaacagcggcuacgacuggaucacggacuuccccggcaagaccgugugguucgugcccuccaucaagagcgggaacgacaucgccaacugccugcggaagaacggcaagcgcgucauccagcucucccggaagaccuucgacaccgaguaccagaagacgaagaacaacgacugggacuacguggugaccaccgacaucagcgagaugggggcgaacuuccgcgccgaccgggucaucgacccccgccggugccugaagcccgugauccugaaggacggccccgagcgcgugauccucgccgggccgaugcccgucaccguggccuccgcggcccagcggcgcggccggaucggccgcaaccagaacaaggagggggaccaguacgucuacaugggccagccccugaacaacgacgaggaccacgcccacuggacggaggccaagaugcugcucgacaacaucaacacccccgaggggaucaucccggcccuguucgagcccgagcgggagaaguccgcggccaucgacggcgaguaccgccugcgcggggaggcccggaagaccuucguggagcucaugcgccggggcgaccugcccguguggcuguccuacaaggucgccagcgagggcuuccaguacuccgaccgccgguggugcuucgacggggagcgcaacaaccaggugcucgaggagaacauggacguggagaucuggaccaaggagggcgagcggaagaagcugcgcccccgguggcuggacgcccgcaccuacagcgacccgcucgcgcugcgggaguucaaggaguucgccgccgggcgccggagcgucuccggcgaccugauccucgagaucggcaagcugccccagcaccugacgcuccgcgcccagaacgcccuggacaaccuggugaugcuccacaacagcgagcagggcgggaaggcguaccggcacgccauggaggagcugcccgacaccaucgagacccugaugcuccuggcccugaucgccgugcucaccgggggcgucacgcuguucuuccuguccgggaagggccucggcaagaccagcaucgggcugcugugcgugaccgcguccagcgcccuccuguggauggccuccguggagccccacuggaucgccgccagcaucauccuggaguucuuccucaugguccugcugaucccggagcccgaccgccagcggacgccccaggacaaccagcucgcguacguggugaucggccugcuguucaugauccucacggucgccgccaacgagauggggcugcuggagaccaccaagaaggaccucggcaucgggcacguggccgccgagaaccaccagcacgcgaccaugcuggacguggaccugcacccggccuccgccuggacgcucuacgccgucgccaccaccgugaucacccccaugaugcgccacacgaucgagaacaccaccgcgaacaucagccugaccgccaucgccaaccaggccgccauccugaugggccucgacaagggcuggcccaucuccaagauggaccugggggugccccugcucgcgcugggcugcuacagccaggucaacccgcugacgcucaccgccgccgugcugaugcugguggcccacuacgcgaucaucgggcccggccuccaggccaaggccacccgggaggcccagaagcgcaccgccgcggggaucaugaagaaccccacggucgacggcaucguggccaucgaccuggaccccguggucuacgacgccaaguucgagaagcagcugggccagaucaugcuccugauccugugcaccucccagauccuccugaugcggaccaccugggcccugugcgagagcaucacgcucgccaccgggccgcugaccacccugugggagggcucccccgggaaguucuggaacacgaccaucgcggugagcauggccaacaucuuccgcggcuccuaccucgccggcgccgggcuggccuucagccugaugaagucccucggcgggggccgccgggggaccggcgcgcagggcgagacccugggggagaaguggaagcgccagcugaaccagcucagcaagagcgaguucaacacguacaagcgguccggcaucauggagguggaccgcagcgaggccaaggaggggcugaagcggggcgagaccaccaagcacgccgucucccgcgggaccgccaagcugcggugguucguggagcgcaaccuggugaagcccgagggcaaggucaucgaccucggcugcgggcggggcggguggagcuacuacugcgcgggccugaagaaggugaccgaggugaagggguacacgaagggcggccccgggcacgaggagccgauccccauggccaccuacggcuggaaccuggucaagcuccacuccgggaaggacguguucuucaugccgcccgagaagugcgacacccugcugugcgacaucggcgagagcuccccgaaccccaccaucgaggaggggcgcacgcuccgggugcugaagauggucgagcccuggcugcgcggcaaccaguucugcaucaagauccucaaccccuacaugccgagcgugguggagacccuggagcagaugcagcggaagcacggcgggaugcugguccgcaacccccucucccggaacagcacccacgagauguacuggguguccugcggcaccgggaacaucgugagcgccgucaacaugacgucccgcaugcugcugaaccgguucaccauggcccaccgcaagcccaccuacgagcgggacguggaccucggcgccggcacccgccacguggcggucgagcccgagguggccaaccuggacaucaucgggcagcgcaucgagaacaucaagaacgagcacaagagcacguggcacuacgacgaggacaacccguacaagaccugggccuaccacggcuccuacgaggugaagcccagcggguccgccagcuccauggucaacggcgugguccggcugcucaccaagcccugggacgugauccccauggugacccagaucgccaugacggacaccaccccguucgggcagcagcgcgucuucaaggagaagguggacacccggacgccccgcgcgaagcggggcaccgcccagaucauggaggugaccgccaaguggcuguggggcuuccugagccgcaacaagaagccccggaucugcacccgcgaggaguucacgcggaagguccgcagcaacgccgccaucggggcgguguucguggacgagaaccaguggaacuccgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggcgaagggcagccgggccaucugguacauguggcucggcgcccgcuuccuggaguucgaggcccugggguucaugaacgaggaccacugguucucccgggagaacagccucuccggcgucgagggggagggccugcacaagcugggguacauccuccgcgacaucagcaagaucccgggcggcaacauguacgccgacgacaccgcggggugggacacccggaucacggaggacgaccugcagaacgaggccaagaucaccgacaucauggagcccgagcacgcccugcucgccaccuccaucuucaagcugaccuaccagaacaagguggugcgcguccagcggcccgccaagaacggcacggugauggacgugaucagccgccgcgaccagcggggguccggccaggucggcaccuacgggcugaacaccuucaccaacauggaggugcagcucauccgccagauggagagcgagggcaucuucuuccccuccgagcuggagagcccgaaccuggcggagcgggugcucgacuggcuggagaagcacggggccgagcgccugaagcggauggccaucuccggcgacgacugcgucgugaagcccaucgacgaccgcuucgccacggcccucaucgcgcugaacgacauggggaaggugcggaaggacaucccccagugggagcccagcaagggcuggaacgacuggcagcaggucccguucugcucccaccacuuccaccagcugaucaugaaggacggccgcgagaucguggugcccugccggaaccaggacgagcucgucgggcgcgcccgggugagccagggcgccggguggucccugcgcgagaccgccugccugggcaagagcuacgcccagauguggcagcucauguacuuccaccggcgcgaccugcggcuggcggccaacgccaucugcagcgccgugcccgucgacugggugcccaccucccgcaccaccuggagcauccacgcgcaccaccaguggaugacgaccgaggacaugcucuccguguggaaccgggucuggaucgaggagaacccguggauggaggacaagacccacgugagcuccugggaggaggugcccuaccuggggaagcgcgaggaccaguggugcggcagccugaucggccucaccgcccgggccacgugggccaccaacauccaggucgccaucaaccaggugcgccgccugaucgggaacgagaacuaccuggacuacaugaccuccaugaagcgguucaagaacgagagcgaccccgagggcgcgcucugguga

SEQ ID NO: 7934 - RNA, 9879 nt, Artificial Sequence
  derived and/or modified CDS sequence (opt1) from DENV-1__JX669473__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccagcuccgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacgagcggggccagcaccucccaggagaccuggaaccgccaggaccuccuggugaccuucaagacggcccacgcgaagaagcaggaggucguggugcugggcagccaggagggcgccaugcacaccgcccucaccggggccaccgagauccagacguccggcaccaccaccaucuucgccgggcaccugaagugccggcugaagauggacaagcucacgcugaagggcaccagcuacgucaugugcaccggguccuucaagcuggagaaggagguggcggagacccagcacggcacggugcugguccaggugaaguacgagggcaccgacgcccccugcaagauccccuucagcacccaggacgagaagggggugacccagaacggccgccucaucacggccaacccgaucgucaccgacaaggagaagcccgugaacaucgagaccgagccgcccuucggggaguccuacaucguggucggcgccggcgagaaggcgcugaagcugagcugguucaagaagggguccagcaucggcaagauguucgaggccaccgcccgcggggcccgccggauggccauccucggcgacacggcgugggacuucggguccaucggcggcguguucaccagcguggggaagcugguccaccagguguucggcaccgccuacggggugcuguucuccggcgucagcuggaccaugaagaucgggaucggcauccuccugacguggcugggccucaacucccgcagcaccucccugagcaugaccugcaucgccguggggauggugacccuguaccucggcgucauggugcaggccgacuccgggugcgugaucaacuggaagggccgcgagcugaagugcgggagcggcaucuucgucacgaacgaggugcacaccuggaccgagcaguacaaguuccaggccgacagcccgaagcggcuguccgcggccaucggccgcgccugggaggagggggugugcggcauccggagcgccacccgccucgagaacaucauguggaagcagaucuccaacgagcugaaccacauccugcucgagaacgacaugaaguucaccgucgugguggggaacgccaacggcauccuggcgcaggggaagaagaugaucaagccccagcccauggagcacaaguacagcuggaaguccuggggcaaggccaagaucaucggcgccgacauccagaacgccacguucaucaucgacgggcccgacaccccggagugccccgacgagcagcgggcguggaacaucugggaggucgaggacuacggcuucgggaucuucaccaccaacaucuggcugaagcuccgcgacagcuacacgcagaugugcgaccaccggcugauguccgccgccaucaaggacagcaaggccgugcacgccgacaugggcuacuggaucgaguccgagaagaacgagaccuggaagcuggcgcgcgccagcuucaucgaggugaagaccugcaucuggcccaagucccacacccucuggagcaacggcguccuggaguccgagaugaucauccccaagauguacgggggcccgaucagccagcacaacuaccggcccggguacuucacgcagaccgccggccccuggcaccuggggaagcucgagcuggacuucgaccugugcgagggcaccaccgugguggucgacgagcacugcggcucccgcgggccgagccuccggacgaccaccgugaccggcaagaucauccacgaguggugcugccgcuccugcacgcugccgccccugcgguuccgcggggaggacggcugcugguacgggauggagauccggcccgugaaggagaaggaggagaaccucguccgcagcauggugagcgccggcuccggcgagguggacagcuucucccuggggauccugugcgucagcaucaugaucgaggaggugaugcggucccgcuggagccggaagaugcucaugaccggcacccuggccguguuccugcuccugaucauggggcagcugaccuggaacgaccucauccgccugugcaucauggucggcgcgaacgccuccgacaagauggggaugggcacgaccuaccuggcccucauggccaccuucaagaugcgcccgauguucgccguggggcugcuguuccggcgccucaccagccgggaggugcugcugcucacgaucgggcugucccuggucgcgagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccaccguccugagcaucgugucccuguucccccucugccugagcaccaccucccagaagacgaccuggcugccggugcuccugggcagcuucgggugcaagccccugaccauguuccucaucaccgagaacaagaucuggggccgcaaguccuggccccugaacgaggggaucauggcgaucggcaucgucagcauccugcucagcucccugcugaagaacgacgugccccucgccgggccgcugaucgccggcggcaugcugaucgccugcuacgugaucagcggguccagcgccgaccucucccuggagaaggcggccgaggucagcugggaggaggaggccgagcacuccggcaccagccacaacauccugguggaggugcaggacgacgggacgaugaagaucaaggacgaggagcgggacgacacccucaccauccugcugaaggccacccuccuggccgucuccggcguguaccccaugagcauccccgcgacgcuguucgugugguacuucuggcagaagaagaagcagcgcuccgggguccucugggacacccccagcccgcccgagguggagcgggccgugcuggacgacggcaucuaccgcauccugcagcggggccugcucgggcgcucccaggucggcguggggguguuccaggacggcgucuuccacaccauguggcacgugacccgcggggccgugcugauguaccagggcaagcgccuggagcccagcugggccuccgucaagaaggaccucaucagcuacggcgggggcuggcgguuccagggguccuggaacacgggcgaggagguccaggugaucgccgucgagcccgggaagaacccgaagaacgugcagaccacccccggcaccuucaagacgcccgagggcgaggugggggcgaucgcccuggacuucaagcccggcaccagcggguccccgaucgucaaccgcgagggcaagaucgugggccuguacgggaacggcguggucaccaccagcgggacguacgugagcgccaucgcccaggccaaggcgucccaggagggcccccuccccgagaucgaggacgagguguucaagaagcggaaccugaccaucauggaccugcacccggggagcggcaagacccgccgguaccuccccgccaucguccgcgaggccaucaagcggaagcugcgcacccugauccucgcccccacgcgggugguggcguccgagauggccgaggcccugaagggcaugcccauccgcuaccagaccaccgccgucaagagcgagcacaccgggcgcgagaucguggaccugaugugccacgccacguucaccaugcggcuccuguccccggugcgcguccccaacuacaacaugaucaucauggacgaggcgcacuucaccgaccccgccagcaucgccgcccggggcuacaucuccacccgcguggggaugggcgaggccgcggccaucuucaugacggccacgccgcccgggagcguggaggccuucccccaguccaacgccgucauccaggacgaggagcgggacauccccgagcgcagcuggaacuccggcuacgacuggaucaccgacuuccccggcaagaccgugugguucgugcccagcaucaaguccgggaacgacaucgcgaacugccugcggaagaacggcaagcgcgucauccagcucagccggaagacguucgacaccgaguaccagaagaccaagaacaacgacugggacuacguggugaccacggacaucuccgagaugggggccaacuuccgcgccgaccgggucaucgacccccgccggugccugaagcccgugauccugaaggacggccccgagcgcgugauccucgccgggccgaugcccgucaccguggcgagcgccgcccagcggcgcggccggaucggccgcaaccagaacaaggagggggaccaguacgucuacaugggccagccccugaacaacgacgaggaccacgcccacuggaccgaggccaagaugcugcucgacaacaucaacacccccgaggggaucaucccggcgcuguucgagcccgagcgggagaaguccgccgccaucgacggcgaguaccgccugcgcggggaggcccggaagacguucguggagcucaugcgccggggcgaccugcccguguggcugagcuacaaggucgccuccgagggcuuccaguacagcgaccgccgguggugcuucgacggggagcgcaacaaccaggugcucgaggagaacauggacguggagaucuggaccaaggagggcgagcggaagaagcugcgcccccgguggcuggacgcgcgcaccuacagcgacccgcucgcccugcgggaguucaaggaguucgccgccgggcgccgguccgucagcggcgaccugauccucgagaucggcaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcggugcucaccgggggcgucacccuguucuuccugagcgggaagggccucggcaagaccuccaucgggcugcugugcgugacggccagcuccgcccuccuguggauggccagcguggagccccacuggaucgccgcguccaucauccuggaguucuuccucaugguccugcugaucccggagcccgaccgccagcggacgccccaggacaaccagcucgccuacguggugaucggccugcuguucaugauccucaccgucgccgccaacgagauggggcugcuggagaccacgaagaaggaccucggcaucgggcacguggccgcggagaaccaccagcacgccaccaugcuggacguggaccugcacccggccagcgccuggacccucuacgccgucgcgaccacggugaucacccccaugaugcgccacaccaucgagaacaccacggccaacaucucccugaccgccaucgccaaccaggccgcgauccugaugggccucgacaagggcuggcccaucagcaagauggaccugggggugccccugcucgcccugggcugcuacucccaggucaacccgcugacccucaccgccgccgugcugaugcugguggcgcacuacgccaucaucgggcccggccuccaggccaaggccacgcgggaggcccagaagcgcaccgcggccgggaucaugaagaaccccaccgucgacggcaucguggccaucgaccuggaccccguggucuacgacgccaaguucgagaagcagcugggccagaucaugcuccugauccugugcaccagccagauccuccugaugcggacgaccugggcccugugcgaguccaucacccucgcgaccgggccgcugacgacccugugggagggcagccccgggaaguucuggaacaccaccaucgccguguccauggccaacaucuuccgcggcagcuaccucgccggcgccgggcuggcguucucccugaugaagucccucggcgggggccgccgggggacgggcgcccagggcgagacccugggggagaaguggaagcgccagcugaaccagcucagcaaguccgaguucaacaccuacaagcggagcggcaucauggagguggaccgcuccgaggccaaggaggggcugaagcggggcgagaccacgaagcacgccgucagccgcgggaccgcgaagcugcggugguucguggagcgcaaccuggugaagcccgagggcaaggucaucgaccucggcugcgggcggggcgggugguccuacuacugcgccggccugaagaaggugaccgaggugaagggguacaccaagggcggccccgggcacgaggagccgauccccauggccaccuacggcuggaaccuggucaagcuccacagcgggaaggacguguucuucaugccgcccgagaagugcgacacgcugcugugcgacaucggcgaguccagcccgaaccccaccaucgaggaggggcgcacccuccgggugcugaagauggucgagcccuggcugcgcggcaaccaguucugcaucaagauccucaaccccuacaugccguccgugguggagacccuggagcagaugcagcggaagcacggcgggaugcugguccgcaacccccucagccggaacuccacgcacgagauguacugggugagcugcggcaccgggaacaucguguccgccgucaacaugaccagccgcaugcugcugaaccgguucaccauggcccaccgcaagcccacguacgagcgggacguggaccucggcgcgggcacccgccacguggccgucgagcccgagguggccaaccuggacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcgugguccggcugcucacgaagcccugggacgugauccccauggugacccagaucgcgaugaccgacaccacgccguucgggcagcagcgcgucuucaaggagaagguggacacccggacgccccgggccaagcggggcaccgcccagaucauggaggugacggccaaguggcuguggggcuuccugagccgcaacaagaagccccggaucugcacccgcgaggaguucacccggaagguccgcuccaacgccgcgaucggggccguguucguggacgagaaccaguggaacagcgccaaggaggccgucgaggacgagcgguucugggaccucgugcaccgcgagcgggagcugcacaagcagggcaagugcgcgaccugcguguacaacaugauggggaagcgcgagaagaagcugggcgaguucgggaaggccaagggcucccgggccaucugguacauguggcucggcgcccgcuuccuggaguucgaggcccugggguucaugaacgaggaccacugguucagccgggagaacucccucagcggcgucgagggggagggccugcacaagcugggguacauccuccgcgacaucuccaagaucccgggcggcaacauguacgcggacgacacggccgggugggacacccggaucaccgaggacgaccugcagaacgaggccaagaucaccgacaucauggagcccgagcacgcccugcucgccacgagcaucuucaagcugaccuaccagaacaagguggugcgcguccagcggcccgcgaagaacggcaccgugauggacgugaucucccgccgcgaccagcgggggagcggccaggucggcaccuacgggcugaacacguucaccaacauggaggugcagcucauccgccagauggaguccgagggcaucuucuuccccagcgagcuggaguccccgaaccuggccgagcgggugcucgacuggcuggagaagcacggggccgagcgccugaagcggauggccaucagcggcgacgacugcgucgugaagcccaucgacgaccgcuucgccaccgcgcucaucgcccugaacgacauggggaaggugcggaaggacaucccccagugggagcccuccaagggcuggaacgacuggcagcaggucccguucugcagccaccacuuccaccagcugaucaugaaggacggccgcgagaucguggugcccugccggaaccaggacgagcucgucgggcgcgcccgggugucccagggcgccggguggagccugcgcgagaccgccugccugggcaagagcuacgcgcagauguggcagcucauguacuuccaccggcgcgaccugcggcuggccgccaacgccaucugcuccgcggugcccgucgacugggugcccacgagccgcaccaccugguccauccacgcccaccaccaguggaugaccaccgaggacaugcucagcguguggaaccgggucuggaucgaggagaacccguggauggaggacaagacgcacguguccagcugggaggaggugcccuaccuggggaagcgcgaggaccaguggugcggcucccugaucggccucaccgcccgggccaccugggccaccaacauccaggucgcgaucaaccaggugcgccgccugaucgggaacgagaacuaccuggacuacaugacgagcaugaagcgguucaagaacgaguccgaccccgagggcgcccucugguga

SEQ ID NO: 7935 - RNA, 9879 nt, Artificial Sequence
  derived and/or modified CDS sequence (opt1) from DENV-1__JX669474__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccgccucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccgccggauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgcgagcugaagugcggguccggcaucuucgucacgaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaugaaguucaccgucgugguggggaacgccaacggcauccuggcgcaggggaagaagaugaucaagccccagcccauggagcacaaguacuccuggaaguccuggggcaaggccaagaucaucggcgccgacauccagaacgccacguucaucaucgacgggcccgacaccccggagugccccgacgagcagcgggcguggaacaucugggaggucgaggacuacggcuucgggaucuucaccaccaacaucuggcugaagcuccgcgacuccuacacgcagaugugcgaccaccggcugaugagcgccgccaucaaggacuccaaggccgugcacgccgacaugggcuacuggaucgagagcgagaagaacgagaccuggaagcuggcgcgcgccuccuucaucgaggugaagaccugcaucuggcccaagagccacacccucugguccaacggcguccuggagagcgagaugaucauccccaagauguacgggggcccgacgucccagcacaacuaccggcccggguacuucacccagaccgccggccccuggcaccuggggaagcucgagcuggacuucgaccugugcgagggcaccacggugguggucgacgagcacugcggcagccgcgggccgucccuccggaccaccaccgugacgggcaagaucauccacgaguggugcugccgcagcugcacccugccgccccugcgguuccgcggggaggacggcugcugguacgggauggagauccggcccgugaaggagaaggaggagaaccucguccgcuccauggugagcgccggcagcggcgagguggacuccuucagccuggggauccugugcgucuccaucaugaucgaggaggugaugcggagccgcuggucccggaagaugcucaugaccggcacccuggccguguuccugcuccugaucauggggcagcugacguggaacgaccucauccgccugugcaucauggucggcgcgaacgccagcgacaagauggggaugggcaccaccuaccuggcccucauggccaccuucaagaugcgcccgauguucgccguggggcugcuguuccggcgccucacgucccgggaggugcugcugcucaccaucgggcugagccuggucgcguccguggagcuccccaacagccuggaggagcugggcgacgggcucgccaugggcaucaugaugcugaagcugcucaccgaguuccagccccaccagcuguggaccacgcugcucucccugaccuucaucaagaccacccugagccucgacuacgccuggaagacgaccgccaccguccuguccaucgugagccuguucccccucugccuguccaccacgagccagaagaccaccuggcugccggugcuccugggcuccuucgggugcaagccccugaccauguuccucaucaccgagaacgagaucuggggccgcaagagcuggccccugaacgaggggaucauggcgaucggcaucgucuccauccugcucagcagccugcugaagaacgacgugccccucgccgggccgcugaucgccggcggcaugcugaucgccugcuacgugaucuccgggagcuccgccgaccucagccuggagaaggcggccgaggucuccugggaggaggaggccgagcacagcggcacgucccacaacauccugguggaggugcaggacgacgggaccaugaagaucaaggacgaggagcgggacgacacccucaccauccugcugaaggccacgcuccuggccaucagcggcgucuaccccauguccauccccgcgacccuguucgugugguacuucuggcagaagaagaagcagcgcagcggggugcucugggacacccccuccccgcccgaggucgagcgggccgugcuggacgacggcaucuaccgcauccugcagcggggccugcucgggcgcagccaggugggcgucgggguguuccaggacggcguguuccacaccauguggcacgucacgcgcggggccgugcugauguaccagggcaagcgccuggagcccuccugggccagcgugaagaaggaccucaucuccuacggcgggggcuggcgguuccaggggagcuggaacaccggcgaggagguccaggugaucgccguggagcccgggaagaacccgaagaacguccagaccacccccggcacguucaagacccccgagggcgaggugggggcgaucgcccuggacuucaagcccggcaccuccgggagcccgaucgugaaccgcgagggcaagaucgucggccuguacgggaacggcguggugaccacguccgggaccuacgucagcgccaucgcccaggccaaggcgagccaggagggcccccuccccgagaucgaggacgagguguucaagaagcggaaccugaccaucauggaccugcacccgggguccggcaagacccgccgguaccuccccgccaucgugcgcgaggccaucaagcggaagcugcgcacgcugauccucgcccccacccgggucguggcgagcgagauggccgaggcccugaagggcaugcccauccgcuaccagaccaccgccgugaaguccgagcacacggggcgcgagaucgucgaccugaugugccacgccaccuucaccaugcggcuccugagcccggugcgcgugcccaacuacaacaugaucaucauggacgaggcgcacuucaccgaccccgccuccaucgccgcccggggcuacaucagcacgcgcgucgggaugggcgaggccgcggccaucuucaugaccgccacgccgcccggguccguggaggccuucccccagagcaacgccgugauccaggacgaggagcgggacauccccgagcgcuccuggaacagcggcuacgacuggaucaccgacuuccccggcaagacggucugguucgugcccuccaucaagagcgggaacgacaucgcgaacugccugcggaagaacggcaagcgcgugauccagcucucccggaagaccuucgacaccgaguaccagaagaccaagaacaacgacugggacuacgucgugacgaccgacaucagcgagaugggggccaacuuccgcgccgaccgggugaucgacccccgccggugccugaagcccgucauccugaaggacggccccgagcgcgugauccucgccgggccgaugcccgugaccgucgcguccgccgcccagcggcgcggccggaucggccgcaaccagaacaaggagggggaccaguacguguacaugggccagccccugaacaacgacgaggaccacgcccacuggaccgaggccaagaugcugcucgacaacaucaacacgcccgaggggaucaucccggcgcuguucgagcccgagcgggagaaguccgccgccaucgacggcgaguaccgccugcgcggggaggcccggaagaccuucgucgagcucaugcgccggggcgaccugcccguguggcuguccuacaagguggccagcgagggcuuccaguacuccgaccgccgguggugcuucgacggggagcgcaacaaccagguccucgaggagaacauggacguggagaucuggaccaaggagggcgagcggaagaagcugcgcccccgguggcuggacgcgcgcaccuacagcgacccgcucgcccugcgggaguucaaggaguucgccgccgggcgccggagcguguccggcgaccugauccucgagaucggcaagcugccccagcaccugacccuccgcgcccagaacgcgcuggacaaccuggucaugcuccacaacagcgagcagggcgggaaggccuaccggcacgccauggaggagcugcccgacacgaucgagacccugaugcuccuggcccugaucgcggugcucaccgggggcgugacccuguucuuccuguccgggaagggccucggcaagacgagcaucgggcugcugugcgucaccgccuccagcgcccuccuguggauggccuccguggagccccacuggaucgccgcgagcaucauccuggaguucuuccucauggugcugcugaucccggagcccgaccgccagcggacgccccaggacaaccagcucgccuacgucgugaucggccugcuguucaugauccucaccguggccgccaacgagauggggcugcuggagacgaccaagaaggaccucggcaucgggcacgucgccgcggagaaccaccagcacgccaccaugcuggacguggaccugcacccggccuccgccuggacccucuacgccguggcgacgaccgucaucacccccaugaugcgccacaccaucgagaacacgaccgccaacaucagccugaccgccaucgccaaccaggccgcgauccugaugggccucgacaagggcuggcccaucuccaagauggaccugggggugccccugcucgcccugggcugcuacagccaggugaacccgcugacccucacggccgccguccugaugcugguggcgcacuacgccaucaucgggcccggccuccaggccaaggccacccgggaggcccagaagcgcaccgcggccgggaucaugaagaaccccaccguggacggcaucgucgccaucgaccuggaccccgugguguacgacgccaaguucgagaagcagcugggccagaucaugcuccugauccugugcacgucccagauccuccugaugcggaccaccugggcccugugcgagagcaucacccucgcgacggggccgcugaccacccugugggagggcucccccgggaaguucuggaacaccacgaucgccgucagcauggccaacaucuuccgcggcuccuaccucgccggcgccgggcuggcguucagccugaugaagucccucggcgggggccgccgggggaccggcgcccagggcgagacccugggggagaaguggaagcgccagcugaaccagcucagcaagagcgaguucaacaccuacaagcgguccggcaucauggagguggaccgcagcgaggccaaggaggggcugaagcggggcgagacgaccaagcacgccgugucccgcgggaccgcgaagcugcggugguucgucgagcgcaaccuggugaagcccgagggcaaggugaucgaccucggcugcgggcggggcggguggagcuacuacugcgccggccugaagaaggucaccgaggugaagggguacaccaagggcggccccgggcacgaggagccgauccccauggccacguacggcuggaaccuggugaagcuccacuccgggaaggacgucuucuucaugccgcccgagaagugcgacacccugcugugcgacaucggcgagagcuccccgaaccccaccaucgaggaggggcgcacccuccgggugcugaagaugguggagcccuggcugcgcggcaaccaguucugcaucaagauccucaaccccuacaugccgagcgucguggagacgcuggagcagaugcagcggaagcacggcgggaugcuggugcgcaacccccucucccggaacagcacccacgagauguacugggucuccugcggcaccgggaacaucgugagcgccgugaacaugaccucccgcaugcugcugaaccgguucacgauggcccaccgcaagcccaccuacgagcgggacgucgaccucggcgcgggcacccgccacguggccguggagcccgaggucgccaaccuggacaucaucgggcagcgcaucgagaacaucaagaacgagcacaagagcaccuggcacuacgacgaggacaacccguacaagacgugggccuaccacggcuccuacgaggugaagcccagcggguccgccagcuccauggugaacggcgucgugcggcugcucaccaagcccugggacgucauccccauggugacccagaucgcgaugaccgacacgaccccguucgggcagcagcgcguguucaaggagaaggucgacacccggacgccccgggccaagcggggcacggcccagaucauggaggugaccgccaaguggcuguggggcuuccugagccgcaacaagaagccccggaucugcacccgcgaggaguucacccggaaggugcgcagcaacgccgcgaucggggccgucuucguggacgagaaccaguggaacuccgccaaggaggccguggaggacgagcgguucugggaccucguccaccgcgagcgggagcugcacaagcagggcaagugcgcgacgugcguguacaacaugauggggaagcgcgagaagaagcugggcgaguucgggaaggccaagggcagccgggccaucugguacauguggcucggcgcccgcuuccuggaguucgaggcccugggguucaugaacgaggaccacugguucucccgggagaacagccucuccggcguggagggggagggccugcacaagcugggguacauccuccgcgacaucagcaagaucccgggcggcaacauguacgcggacgacaccgccgggugggacacccggaucaccgaggacgaccugcagaacgaggccaagaucacggacaucauggagcccgagcacgcccugcucgccaccuccaucuucaagcugaccuaccagaacaaggucgugcgcgugcagcggcccgcgaagaacggcaccgucauggacgugaucagccgccgcgaccagcggggguccggccaggugggcacguacgggcugaacaccuucaccaacauggagguccagcucauccgccagauggagagcgagggcaucuucuuccccuccgagcuggagagcccgaaccuggccgagcgggugcucgacuggcuggagaagcacggggccgagcgccugaagcggauggccaucuccggcgacgacugcguggucaagcccaucgacgaccgcuucgccaccgcgcucaucgcccugaacgacauggggaaggugcggaaggacaucccccagugggagcccagcaagggcuggaacgacuggcagcaggucccguucugcucccaccacuuccaccagcugaucaugaaggacggccgcgagaucgucgugcccugccggaaccaggacgagcucguggggcgcgcccgggucagccagggcgccggguggucccugcgcgagacggccugccugggcaagagcuacgcgcagauguggcagcucauguacuuccaccggcgcgaccugcggcuggccgccaacgccaucugcagcgcggugcccguggacuggguccccaccucccgcaccaccuggagcauccacgcccaccaccaguggaugaccacggaggacaugcucuccguguggaaccggguguggaucgaggagaacccguggauggaggacaagacccacgucagcuccugggaggaggugcccuaccuggggaagcgcgaggaccaguggugcggcagccugaucggccucaccgcccgggccaccugggccacgaacauccagguggcgaucaaccagguccgccgccugaucgggaacgagaacuaccuggacuacaugaccuccaugaagcgguucaagaacgagagcgaccccgagggcgcccucugguga

SEQ ID NO: 7936 - RNA, 9879 nt, Artificial Sequence
  derived and/or modified CDS sequence (opt1) from DENV-1__JX669475__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacccgcaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggcaaggccugggaggagggggugugcggcauccgcuccgccacccggcucgagaacaucauguggaagcagaucagcaacgagcugaaccacauccugcucgagaacgacaucaaguucacggucgugguggggaacgccaacggcauccuggcgcaggggaagaagaugauccgcccccagcccauggagcacaaguacuccuggaaguccuggggcaaggccaagaucaucggcgccgacauccagaacaccaccuucaucaucgacgggcccgacaccccggagugccccgacgagcagcgggccuggaacaucugggaggucgaggacuacggcuucgggaucuucacgaccaacaucuggcugaagcuccgcgacuccuacacccagaugugcgaccaccggcugaugagcgcggccaucaaggacuccaaggccgugcacgccgacaugggcuacuggaucgagagcgagaagaacgagaccuggaagcuggcccgcgcguccuucaucgaggugaagacgugcaucuggcccaagagccacacccucugguccaacggcguccuggagagcgagaugaucauccccaagauguacgggggcccgaucucccagcacaacuaccggcccggguacuucacccagaccgccggccccuggcaccuggggaagcucgagcuggacuucgaccugugcgagggcacgaccgugguggucgacgagcacugcggcagccgcgggccgucccuccggaccaccacggugaccggcaagaucauccacgaguggugcugccgcagcugcacccugccgccccugcgguuccgcggggaggacggcugcugguacgggauggagauccggcccgugaaggagaaggaggagaaccucguccgcuccauggugagcgccggcagcggcgagguggacuccuucagccuggggauccugugcgucuccaucaugaucgaggaggugaugcggagccgcuggucccggaagaugcucaugaccggcacgcuggccguguuccugcuccugaucauggggcagcugaccuggaacgaccucauccgccugugcaucauggucggcgccaacgcgagcgacaagauggggaugggcaccaccuaccuggcccucauggccacguucaagaugcgcccgauguucgccguggggcuguccuuccggcgccugaccagccgggaggugcuccugcugaccaucgggcucucccuggucgccagcguggagcugcccaacucccucgaggagcugggcgacgggcuggcgaugggcaucaugaugcucaagcugcugaccgaguuccagccccaccagcucuggacgacccugcugagccucaccuucaucaagaccacgcugucccuggacuacgccuggaagaccaccgccaugguccucagcaucgugucccuguucccccugugccucagcaccacgucccagaagaccaccuggcugccggugcugcucggcagcuucgggugcaagccccugaccauguuccugaucaccgagaacgagaucuggggccgcaaguccuggccccucaacgaggggaucauggccaucggcaucgucagcauccugcugagcucccuccugaagaacgacgugccccuggcggggccgcucaucgccggcggcaugcugaucgccugcuacgugaucagcggguccagcgccgaccugucccucgagaaggccgcggaggucagcugggaggaggaggccgagcacuccggcacgagccacaacauccugguggaggugcaggacgacgggaccaugaagaucaaggacgaggagcgggacgacacccugaccauccuccugaaggccacgcugcucgccgucuccggcguguaccccaugagcauccccgccacccuguucgugugguacuucuggcagaagaagaagcagcgcuccgggguccugugggacacccccagcccgcccgagguggagcgggcggugcucgacgacggcaucuaccgcauccugcagcggggccugcuggggcgcucccaggucggcguggggguguuccaggacggcgucuuccacaccauguggcacgugacgcgcggggccgugcucauguaccagggcaagcgccuggagcccagcugggccuccgucaagaaggaccugaucagcuacggcgggggcuggcgguuccagggguccuggaacaccggcgaggagguccaggugaucgccgucgagcccgggaagaacccgaagaacgugcagaccacccccggcacguucaagacccccgagggcgaggugggggccaucgcgcucgacuucaagcccggcaccagcggguccccgaucgucaaccgcgagggcaagaucgugggccuguacgggaacggcguggucaccacgagcgggaccuacgugagcgccaucgcccaggccaaggccucccaggagggcccccugcccgagaucgaggacgagguguuccggaagcgcaaccucaccaucauggaccugcacccggggagcggcaagacccggcgcuaccugcccgcgaucguccgggaggccaucaagcgcaagcuccggacgcugauccuggcccccacccgcgugguggccuccgagauggcggaggcccucaagggcaugcccauccgcuaccagaccaccgccgucaagagcgagcacacggggcgggagaucguggaccugaugugccacgccaccuucaccaugcgccugcucuccccggugcggguccccaacuacaacaugaucaucauggacgaggcccacuucaccgaccccgcgagcaucgccgcccgcggcuacaucuccacgcggguggggaugggcgaggccgccgcgaucuucaugaccgccacgccgcccgggagcguggaggccuucccccaguccaacgccgucauccaggacgaggagcgcgacauccccgagcggagcuggaacuccggcuacgacuggaucaccgacuuccccggcaagacggugugguucgugcccagcaucaaguccgggaacgacaucgccaacugccugcgcaagaacggcaagcgggucauccagcugagccgcaagaccuucgacaccgaguaccagaagaccaagaacaacgacugggacuacguggugacgaccgacaucuccgagaugggggcgaacuuccgggccgaccgcgucaucgacccccggcgcugccucaagcccgugauccugaaggacggccccgagcgggugauccuggccgggccgaugcccgucaccguggccagcgcggcccagcgccggggccgcaucggccggaaccagaacaaggagggggaccaguacgucuacaugggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccgccugcgcggggaggcccgcaagaccuucguggagcugaugcggcgcggcgaccuccccguguggcugagcuacaaggucgccuccgagggcuuccaguacagcgaccggcgcuggugcuucgacggggagcggaacaaccaggugcuggaggagaacauggacguggagaucuggaccaaggagggcgagcgcaagaagcuccggccccgcuggcuggacgcccggaccuacagcgacccgcuggcgcuccgcgaguucaaggaguucgccgccgggcggcgcuccgucagcggcgaccugauccuggagaucggcaagcucccccagcaccugacccugcgggcccagaacgcccucgacaaccuggugaugcugcacaacuccgagcagggcgggaaggcguaccgccacgccauggaggagcuccccgacacgaucgagacccugaugcugcucgcccugaucgccgugcugaccgggggcgucacccucuucuuccugagcgggaagggccugggcaagacguccaucgggcuccugugcgugaccgcgagcuccgcccugcucuggauggccagcguggagccccacuggaucgccgccuccaucauccuggaguucuuccugaugguccuccugaucccggagcccgaccggcagcgcacgccccaggacaaccagcuggcguacguggugaucggccuccuguucaugauccugaccgucgccgccaacgagauggggcuccuggagacgaccaagaaggaccugggcaucgggcacguggccgccgagaaccaccagcacgcgaccaugcucgacguggaccugcacccggccagcgccuggacccuguacgccgucgccacgaccgugaucacccccaugaugcggcacaccaucgagaacacgaccgcgaacaucucccucaccgccaucgccaaccaggccgccauccugaugggccuggacaagggcuggcccaucagcaagauggaccucggggugccccugcuggcgcucggcugcuacucccaggucaacccgcugacccugacggccgccgugcucaugcugguggcccacuacgcgaucaucgggcccggccugcaggccaaggccacccgcgaggcccagaagcggaccgccgcggggaucaugaagaaccccaccgucgacggcaucguggccaucgaccucgaccccguggucuacgacgccaaguucgagaagcagcugggccagaucaugcugcucauccugugcacgagccagauccugcucaugcgcaccaccugggcccugugcgaguccaucacccuggccacggggccgcucaccacccugugggagggcagccccgggaaguucuggaacaccacgaucgcgguguccauggccaacaucuuccgcggcagcuaccuggccggcgccgggcucgccuucucccugaugaagucccugggcgggggccggcgcgggaccggcgcgcagggcgagacccucggggagaaguggaagcggcagcugaaccagcugagcaaguccgaguucaacaccuacaagcgcagcggcaucauggagguggaccgguccgaggccaaggaggggcucaagcgcggcgagacgaccaagcacgccgucagccgggggaccgccaagcugcgcugguucguggagcggaaccuggugaagcccgagggcaaggucaucgaccugggcugcgggcgcggcgggugguccuacuacugcgcgggccucaagaaggugaccgaggugaagggguacaccaagggcggccccgggcacgaggagccgauccccauggccacguacggcuggaaccuggucaagcugcacagcgggaaggacguguucuucaugccgcccgagaagugcgacacccuccugugcgacaucggcgaguccagcccgaaccccaccaucgaggaggggcggacccugcgcgugcucaagauggucgagcccuggcugcggggcaaccaguucugcaucaagauccugaaccccuacaugccguccgugguggagacgcucgagcagaugcagcgcaagcacggcgggaugcugguccggaacccccugagccgcaacuccacccacgagauguacugggugagcugcggcaccgggaacaucguguccgccgucaacaugaccagccggaugcuccugaaccgcuucacgauggcccaccggaagcccaccuacgagcgcgacguggaccugggcgccggcacccgccacguggcggucgagcccgagguggccaaccucgacaucaucgggcagcggaucgagaacaucaagaacgagcacaaguccaccuggcacuacgacgaggacaacccguacaagacgugggccuaccacggcagcuacgaggugaagcccuccgggagcgccuccagcauggucaacggcgugguccgccugcugaccaagcccugggacgugauccccauggugacccagaucgccaugaccgacacgaccccguucgggcagcagcgggucuucaaggagaagguggacacccgcacgccccgggcgaagcgcggcacggcccagaucauggaggugaccgccaaguggcucuggggcuuccugagccggaacaagaagccccgcaucugcacccgggaggaguucacccgcaagguccgguccaacgccgccaucggggcgguguucguggacgagaaccaguggaacagcgccaaggaggccgucgaggacgagcgcuucugggaccuggugcaccgggagcgcgagcuccacaagcagggcaagugcgccacgugcguguacaacaugauggggaagcgggagaagaagcugggcgaguucgggaaggcgaagggcucccgcgccaucugguacauguggcugggcgcccgguuccucgaguucgaggcccugggguucaugaacgaggaccacugguucagccgcgagaacucccugagcggcgucgagggggagggccuccacaagcugggguacauccugcgggacaucuccaagaucccgggcggcaacauguacgccgacgacaccgcggggugggacacccgcaucaccgaggacgaccuccagaacgaggccaagaucacggacaucauggagcccgagcacgcccugcuggccaccagcaucuucaagcucaccuaccagaacaagguggugcggguccagcgccccgccaagaacggcaccgugauggacgugaucucccgccgggaccagcgcgggagcggccaggucggcacguacgggcugaacaccuucaccaacauggaggugcagcugauccggcagauggaguccgagggcaucuucuuccccagcgagcucgaguccccgaaccuggcggagcgcgugcuggacuggcucgagaagcacggggccgagcggcugaagcgcauggccaucagcggcgacgacugcgucgugaagcccaucgacgaccgguucgccaccgcccugaucgcgcucaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcuggucgggcgggcccgcgugucccagggcgccggguggagccuccgggagacggccugccugggcaagagcuacgcccagauguggcagcugauguacuuccaccgccgggaccuccgccuggcggccaacgccaucugcuccgccgugcccgucgacugggugcccaccagccggaccaccugguccauccacgcgcaccaccaguggaugaccacggaggacaugcugagcguguggaaccgcgucuggaucgaggagaacccguggauggaggacaagacccacguguccagcugggaggaggugcccuaccucgggaagcgggaggaccaguggugcggcucccugaucggccugaccgcccgcgccaccugggccacgaacauccaggucgccaucaaccaggugcgccggcucaucgggaacgagaacuaccuggacuacaugaccagcaugaagcgcuucaagaacgaguccgaccccgagggcgcgcugugguga

SEQ ID NO: 7937 - RNA, 9879 nt, Artificial Sequence
  derived and/or modified CDS sequence (opt1) from DENV-1__JX669461__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgcgauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagauggugauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgagauggacagcuucagccucgggauccugugcgucuccauccugaucgaggaggugaugcggagccgcuggucccggaagaugcucaugaccggcacccuggccguguuccugcuccugaucauggggcagcugacguggaacgaccucauccgccugugcaucauggucggcgccaacgccagcgacaagauggggaugggcaccaccuaccuggcccucauggcgacccugaagaugcgcccgauguucgccgugggccuccucuuccggcgccugacgucccgggaggugcugcuccugaccgucgggcugagccucguggccuccgucgagcugcccaacagccuggaggagcucggcgacgggcuggccaugggcaucaugaugcugaagcuccugaccgacuuccagccccaccagcuguggaccacgcuccugucccugaccuucauccgcaccagccucucccuggacuacgccuggaagaccauggcgauggcccugagcaucgugucccucuucccccugugccugagcacgaccucccagaagaccaccuggcucccggugcugcugggcagcuucgggugcaagccccucacgauguuccugaucaccgagaacaagaucuggggccggaaguccuggcccaucaacgaggggaucauggccgucggcaucgugagcauccugcucuccagccugcugaagaacgacgugccccucgccgggccgcugaucgcgggcggcaugcugaucgccugcuacgucaucagcggguccagcgccgaccucucccuggagaaggccgccgaggugagcugggaggaggaggcggagcacuccggcaccagccacaacauccugguggagguccaggacgacgggaccaugaagaucaaggacgaggagcgcgacgacacccucacgauccugcugaaggccacccuccuggccguguccggcguguaccccaugagcauccccgccacccuguucgucugguacuucuggcagaagaagaagcagcgguccggggugcugugggacacccccagcccgcccgagguggagcgcgccguccucgacgacggcaucuaccggauccugcagcgcggccugcucgggcggucccaggugggcgugggggucuuccaggacggcguguuccacacgauguggcacgugacccgcggggcgguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagaccacgcccggcaccuucaagacccccgagggcgaggucggggccaucgcccuggacuucaagcccggcaccagcggguccccgaucgugaaccgggagggcaagaucgugggccuguacgggaacggcgucgugacgaccagcgggaccuacguguccgcgaucgcccaggccaaggccacccaggagggcccccuccccgagaucgaggacgaggucuucaagaagcgcaaccugacgaucauggaccugcacccggggagcggcaagacccggcgcuaccuccccgccaucgugcgggaggcgaucaagcgcaagcugcggacccugauccucgcccccacccgcguggucgccagcgagauggccgaggcgcugaagggcaugcccauccgcuaccagacgaccgccgugaaguccgagcacaccgggcgggagaucguggaccugaugugccacgccaccuucacgaugcgccuccugagcccgguccgggugcccaacuacaacaugaucaucauggacgaggcccacuucaccgaccccgccuccaucgcggcccgcggcuacaucagcacccggguggggaugggcgaggccgccgccaucuucaugaccgcgacgcccccgggguccgucgaggccuucccccagagcaacgccgugauccaggacgaggagcgcgacauccccgagcgguccuggaacagcggcuacgacuggaucaccgacuuccccggcaagaccgugugguucgucccguccaucaagagcgggaacgacaucgccaacugccugcgcaagaacggcaagcgggugauccagcucucccgcaagaccuucgacacggaguaccagaagaccaagaacaacgacugggacuacguggucaccaccgacaucagcgagaugggggccaacuuccgggcggaccgcgugaucgacccccggcgcugccugaagcccgugauccugaaggagggccccgagcgggucauccucgccgggccgaugcccgugacggucgccuccgccgcgcagcgccggggccgcaucggccggaaccagaacaaggagggggaccaguacaucuacaugggccagccccugaacaacgacgaggaccacgcccacuggaccgaggccaagaugcugcucgacaacaucaacacccccgaggggaucaucccggcccuguucgagcccgagcgcgagaaguccgccgcgaucgacggcgaguaccgccugcgcggggaggcccgcaagaccuucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggacgaaggagggcgagcgcaagaagcugcggccccgcuggcuggacgcccggaccuacagcgacccgcucgcccugcgcgaguucaaggaguucgcggccgggcggcgcuccgucagcggcgaccugauccucgagaucggcaagcugccccagcaccugacccuccgggcccagaacgcccuggacaaccuggugaugcuccacaacagcgagcagggcgggaaggccuaccgccacgcgauggaggagcugcccgacaccaucgagacccugaugcuccuggcccugaucgccgugcucaccggcggggucacccuguucuuccuguccgggaaggggcucggcaagaccagcaucgggcugcugugcgugauggccuccagcgcgcuccuguggauggccuccguggagccccacuggaucgccgccagcaucauccuggaguucuuccucaugguccugcugaucccggagcccgaccggcagcgcacgccccaggacaaccagcucgccuacguggugaucggccugcuguucaugauccucacggucgcggccaacgagauggggcugcuggagaccaccaagaaggaccucggcaucgggcacguggccguggagaaccaccaccacgccaccaugcuggacgucgaccugcggccggccuccgcguggacgcucuacgccguggccaccaccgugaucacccccaugaugcgccacacgaucgagaacaccaccgccaacaucagccugaccgccaucgcgaaccaggccgccauccugaugggccucgacaagggcuggcccaucuccaagauggacaucggggucccccugcuggcccucggcugcuacagccaggugaacccgcugacgcugaccgccgcggugcucaugcuggucgcccacuacgccaucaucgggcccggccugcaggccaaggcgacccgggaggcccagaagcgcaccgccgccgggaucaugaagaaccccacgguggacggcaucgugaccaucgaccucgaccccgucguguacgacgccaaguucgagaagcagcugggccagaucaugcugcucauccugugcaccucccagauccugcucaugcgcaccacgugggcgcugugcgagagcaucacccuggccaccgggccgcucaccacgcugugggagggcucccccgggaaguucuggaacaccaccaucgccgugagcauggccaacaucuuccggggcuccuaccuggccggcgcggggcucgccuucagccugaugaagucccugggcgggggccgccgggggaccggcgcccagggcgagacgcucggggagaaguggaagcgccagcugaaccagcugagcaaguccgaguucaacaccuacaagaaguccggcaucauggaggucgaccggagcgaggccaaggaggggcugaagcgcggcgagaccaccaagcacgccgugucccgggggacggcgaagcuccgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagccgauccccauggccaccuacggcuggaaccuggugaagcugcacuccgggaaggacguguucuucacgccgcccgagaagugcgacacgcuccugugcgacaucggcgagagcuccccgaaccccaccaucgaggaggggcggacccugcgcguccucaagaugguggagcccuggcugcggggcaaccaguucugcaucaagauccugaaccccuacaugccgagcguggucgagacccucgagcagaugcagcgcaagcacggcgggaugcuggugcggaacccccugucccgcaacagcacgcacgagauguacuggguguccugcggcaccgggaacaucgucagcgccgugaacaugaccucccggaugcuccugaaccgcuucaccauggcgcaccggaagcccacguacgagcgcgacguggaccugggcgccggcacccgccacgucgccguggagcccgagguggccaaccucgacaucaucgggcagcggaucgagaacaucaagaacgagcacaagagcaccuggcacuacgacgaggacaacccguacaagaccugggccuaccacggcuccuacgaggucaagcccagcggguccgcgagcuccauggugaacggcgucgugcgccugcugacgaagcccugggacgugauccccauggucacccagaucgccaugaccgacaccacgccguucgggcagcagcggguguucaaggagaagguggacacccgcacgccccgggccaagcgcggcaccgcccagaucauggaggucacggccaaguggcucuggggcuuccugagccggaacaagaagccccgcaucugcacccgggaggaguucacccgcaaggugcgguccaacgcggccaucggggccguguucgucgacgagaaccaguggaacagcgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagaucccgggcggcaacauguacgccgacgacacggccgggugggacacccgcaucaccgaggacgaccuccagaacgaggccaagaucaccgacaucauggagcccgagcacgcccugcuggcgacguccaucuucaagcucaccuaccagaacaaggugguccgggugcagcgccccgccaagagcggcaccgugauggacgucaucucccgccgggaccagcgcgggagcggccaggugggcaccuacgggcugaacacguucaccaacauggaggugcagcugauccggcagauggaguccgagggcaucuucagccccuccgagcucgagaccccgaaccuggccaagaagguccuggacuggcucgagaagcacggggccgagcgccugaagcggauggccaucagcggcgacgacugcguggugaagcccaucgacgaccgcuucgcgaccgcccugacggcccucaacgacauggggaagguccggaaggacaucccccagugggagcccuccaagggcuggaacgacuggcagcaggucccguucugcagccaccacuuccaccagcugaucaugaaggacggccgcgagaucgugguccccugccggaaccaggacgagcugguggggcgcgcccgggugucccagggcgccggguggagccuccgcgagaccgcgugccugggcaaguccuacgcccagauguggcagcugauguacuuccaccggcgcgaccuccggcuggccgccaacgccaucugcagcgcgguccccguggacugggugcccaccagccgcaccaccugguccauccacgcccaccaccaguggaugacgaccgaggacaugcugagcgucuggaaccggguguggaucgaggagaacccguggauggaggacaagacccacguguccagcugggaggagguccccuaccucgggaagcgcgaggaccaguggugcggcucccugaucggccugaccgcccgggccacgugggcgaccaacauccagguggccaucaaccaggugcgccgccucaucgggaacgagaacuaccuggacuacaugaccagcaugaagcgguucaagaacgaguccgaccccgagggcgcccugugguga

SEQ ID NO: 7938 - RNA, 9879 nt, Artificial Sequence
  derived and/or modified CDS sequence (opt1) from DENV-1__KF184975__SS-prME
agcgugaccaugcugcugaugcugaugcccaccgcccuggccuuccaccucaccacccggggcggggagccccacaugaucgugagcaagcaggagcggggcaagagccugcuguucaagaccuccgcgggggugaacaugugcacccucaucgccauggaccugggcgagcugugcgaggacaccaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccugacgugcgccaaguucaagugcgugaccaagcuggagggcaagaucguccaguacgagaaccucaaguacagcgugaucgugaccguccacaccgaggaccagcaccaggugggcaacgagacgaccgagcacgggaccaucgcgaccaucacgccccaggcccccacguccgagauccagcugaccgacuacggcgcccugacccucgacugcagcccccgcaccgggcuggacuucaacgagaugguccugcucacgaugaaggagaaguccuggcuggugcacaagcagugguuccuggaccucccccugcccuggaccagcggcgccagcaccucccaggagaccuggaaccggcaggaccugcucgugacguucaagaccgcccacgcgaagaagcaggaggucguggugcuggggagccaggagggcgccaugcacaccgcccugaccggcgccacggagauccagaccuccgggaccaccacgaucuucgccggccaccucaagugccgccugaagauggacaagcugacccucaaggggaugagcuacgucaugugcaccggcuccuucaagcuggagaaggagguggcggagacccagcacgggacggugcugguccaggugaaguacgagggcaccgacgcccccugcaagauccccuucagcauccaggacgagaagggcgugauccagaacgggcggcugaucaccgccaacccgaucgucaccgacaaggagaagcccgugaacaucgagacggagccgcccuucggcgaguccuacaucguggucggggccggcgagaagacccucaagcugagcugguucaagaagggcuccagcaucgggaagauguucgaggcgaccgcccgcggcgcccggcgcauggccauccugggggacaccgccugggacuucggcuccaucgggggcguguucacgagcgugggcaagcucguccaccagguguucgggaccgcguacggcgugcuguucuccggggucagcuggaccaugaagaucggcaucgggauccugcucaccuggcugggccugaacucccgcagcacgucccucagcaugaccugcaucgccgugggcauggugacccuguaccugggggucauggugcaggccgacuccggcugcgugaucaacuggaaggggcgggagcucaagugcggcagcgggaucuucgucaccaacgaggugcacacguggaccgagcaguacaaguuccaggccgacagcccgaagcgccuguccgccgcgaucggcaaggccugggaggagggcgugugcgggauccggagcgccacccgccuggagaacgucauguggaagcagaucuccaacgagcucaaccacauccugcuggagaacgacaugaaguucaccgugguggucggcgacgugaacgggauccucgcccagggcaagaagauggugcggccccagcccauggagcacaaguacagcuggaaguccugggggaaggccaagaucaucggcgcggacauccagaacaccacguucaucaucgacggccccgacaccccggagugccccgacgaccagcgcgccuggaacaucugggaggucgaggacuacggguucggcaucuucaccaccaacaucuggcugaagcugcgggacagcuacacgcagaugugcgaccaccgccucauguccgccgccaucaaggacagcaaggcggugcacgccgacaugggguacuggaucgaguccgagaagaacgagaccuggaagcuggcccgggccagcuucaucgaggugaagaccugcaucuggcccaagucccacacccuguggagcaacggcguccucgaguccgagaugaucauccccaagaucuacggcgggccgacgagccagcacaacuaccgccccggcuacuucacccagaccgccgggcccuggcaccugggcaagcuggagcucgacuucgaccugugcgaggggaccacggugguggucgacgagcacugcggcaaccggggcccgucccugcgcaccaccaccgugacggggaagaucauccacgaguggugcugccggagcugcacccugccgccccuccgcuucaagggcgaggacgggugcugguacggcauggagauccggcccgugaaggagaaggaggagaaccugguccgcuccauggugagcgcggggagcggcgagguggacaacuucucccucggccugcugugcgucagcaucaugguggaggaggugaugcggucccgcuggagccggaagaugcucaugaccgggacccuggccgucuuccugcuccugaucaugggccagcugacguggaacgaccucauccgccugugcaucauggugggggccaacgccuccgaccgcaugggcauggggaccaccuaccuggcccucauggcgaccuucaagaugcggccgauguucgccgucggccugcuguuccgccggcucacgagccgcgaggugcugcugcucaccaucggccugucccugguggccagcgucgagcuccccaacucccuggaggagcugggggacggccucgccauggggaucaugaugcugaagcugcucaccgacuuccagagccaccagcuguggaccacgcugcucucccugaccuucgugaagaccacccugagccucgacuacgccuggaagacgauggcgauggugcuguccaucgucagccuguucccccucugccuguccaccaccagccagaagaccacguggcugcccgugcuccugggcuccuucggcugcaagccgcugaccauguuccucaucaccgagaacaagaucugggggcggaaguccuggccccugaacgagggcaucauggccguggggaucgccuccauccugcucagcagccugcugaagaacgacgucccccucgccggcccccugaucgccggcgggaugcugaucgccugcuacgugaucuccgggagcuccgccgaccucagccuggagaaggccgccgagguguccugggaggaggaggcggagcacagcggggccucccacaacauccuggucgaggugcaggacgacggcaccaugaagaucaaggacgaggagcgcgacgacacccucacgauccugcugaaggccacccuccuggccgugagcggggucuacccgauguccauccccgccacccuguucgugugguacuucuggcagaagaagaagcagcggagcggcgugcucugggacacccccagcccgcccgaggcggagaaggccguccuggacgacgggaucuaccgcauccugcagcggggccugcucggccgcagccaggugggggugggcgucuuccaggacgggguguuccacacgauguggcacgugacccggggcgccguccugauguaccaggggaagcgcguggagcccuccugggccagcgugaagaaggaccugaucuccuacggcggcggguggcgguuccagggccucuggaacaccggggaggagguccaggugaucgccguggagcccggcaagaacccccgcaacguccagaccacgcccgggaccuucaagacccccgagggcgaggugggcgcgaucgcccuggacuucaagcccgggaccagcggcucccccaucgugaaccgggaggggaagaucgucggccuguacggcaacgggguggugacgaccagcggcaccuacgucuccgccaucgcccaggccaaggcgagccaggaggggccgcuccccgagaucgaggacgagguguuccgcaagcggaaccugaccaucauggaccugcaccccggcagcgggaagacgcgccgguaccucccggccaucgugcgcgaggccaucaagcggaagcugcgcacccugauccucgcccccacccgcgucguggcguccgagauggccgaggcccugaagggcaugcccauccgguaccagaccacggccgugaagaccgagcacaccggccgcgagaucgucgaccugaugugccacgccaccuucacgaugcggcuccugagccccgugcgcgugccgaacuacaacaugaucaucauggacgaggcgcacuucaccgaccccgccuccaucgccgcccggggguacaucagcacccgcgucggcaugggggaggccgcggccaucuucaugaccgccacgccgcccggcuccauggaggccuucccgcagagcaacgccgugauccaggacgaggagcgggacauccccgagcgcuccuggaacagcggguacgacuggaucaccgacuuccccggcaagaccgugugguucguccccuccaucaagagcggcaacgacaucgcgaacugccugcggaagaacgggaagcgcgugauccagcucucccggaagaccuucgacacggaguaccagaagaccaagaacaacgacugggacuacguggucaccaccgacaucagcgagaugggcgccaacuuccgcgccgaccgggugaucgacccgcgccggugccugaagcccgucauccugaaggacgggcccgagcgcgugauccucgccggccccaugccggugacggucgcguccgccgcccagcggcgcgggcggaucggccgcaaccagaacaaggagggcgaccaguacguguacauggggcagccccugaacaacgacgaggaccacgcccacuggaccgaggccaagaugcugcucgacaacaucaacacccccgagggcaucauccccgcgcuguucgagccggagcgcgagaaguccgccgccaucgacggggaguaccggcugcgcggcgaggcccggaagaccuucguggagcucaugcgccgcggggaccugcccgucuggcuguccuacaagguggccagcgagggcuuccaguacuccgaccgccgguggugcuucgacggcgagcgcaacaaccaggugcucgaggagaacauggacgucgagaucuggacgaaggagggggagcggaagaagcugcgcccccgguggcuggacgcgcgcaccuacagcgacccccucgcccugcgggaguucaaggaguucgccgccggccgccgguccgugagcggggaccugauccucgagaucggccgccugccgcagcaccugacccucaaggcccagaacgcgcuggacaaccuggugaugcuccacaacagcgagcagggcgggaaggccuaccggcacgccauggaggagcugcccgacaccaucgagacccugaugcuccuggcccugaucgcgguccucacgggcggggugacccuguucuuccuguccggcaaggggcucggcaagaccagcaucggccugcugugcgugauggccuccagcguccuccuguggauggccuccguggagccccacuggaucgccgccagcaucauccuggaguucuuccucauggugcugcugauccccgagccggaccgccagcggacgccccaggacaaccagcucgcguacgucgugaucgggcugcuguucaucauccucacgguggccgccaacgagaugggccugcuggagaccaccaagaaggaccucgggaucggccacgucgccgccgaggaccaccagcacgcgaccaugcuggacguggaccugcgccccgccuccgccuggacgcucuacgccguggccaccaccaucaucaccccgaugaugcggcacacgaucgagaacaccaccgcgaacaucagccugaccgccaucgccaaccaggccgccauccugauggggcucgacaagggcuggcccaucuccaagauggacaucggcgucccccugcuggcgcucgggugcuacagccaggugaacccccugacgcugaccgccgccgugcucaugcuggucgcccacuacgcgaucaucggcccggggcugcaggccaaggccacccgcgaggcccagaagcgcaccgccgcgggcaucaugaagaaccccacgguggacgggaucguggccaucgaccucgaccccgucguguacgacaccaaguucgagaagcagcugggccagaucaugcugcucauccugugcaccucccagauccugcucaugcggaccacgugggcccugugcgagagcaucacccuggccaccggcccccucaccacgcugugggagggguccccgggcaaguucuggaacaccaccaucgccgugagcauggcgaacaucuuccgcggguccuaccuggccggcgccggccucgccuucagccugaugaagucccucgggggcgggcggcgcgggaccggggcccagggcgagacgcucggcgagaaguggaagcggcagcugaaccagcugagcaaguccgaguucaacaccuacaagcgcagcgggaucaccgaggucgaccggagcgaggcgaaggagggccucaagcgcggggagaccacgaagcacgccgugucccggggcgccgccaagcugcgcugguucguggagcggaaccuggucaagcccgaggggaaggugaucgaccugggcugcggccgcgggggcuggagcuacuacugcgcggggcucaagaaggugaccgaggucaagggcuacaccaagggcgggcccggccacgaggagcccaucccgauggccaccuacggguggaaccuggugaagcugcacuccggcaaggacguguucuucaucccgcccgagaagugcgacacccuccugugcgacaucggggagagcucccccaacccgacgaucgaggagggccggacccugcgcguccucaagaugguggagcccuggcugcgggggaaccaguucugcaucaagauccugaaccccuacaugcccagcguggucgagacccucgagcagaugcagcgcaagcacggcggcaugcuggugcggaacccgcugucccgcaacagcacccacgagauguacuggguguccugcgggacgggcaacaucgucagcgccgugaacaugaccucccggaugcuccugaaccgcuucaccauggcccaccgcaagcccaccuacgagcgggacguggaccugggggccggcacgcgccacgucgcgguggagcccgaggucgccaaccucgacaucaucggccagcggaucgagaacaucaagaacgagcacaagagcaccuggcacuacgacgaggacaaccccuacaagaccugggccuaccacggguccuacgaggugaagccgagcggcuccgccagcuccauggugaacggggucgugcgccugcugaccaagcccugggacgugauccccauggucacgcagaucgccaugaccgacaccacccccuucggccagcagcggguguucaaggagaagguggacacgcgcaccccgcgggcgaagcgcgggaccgcccagaucauggaggucaccgccaaguggcucuggggcuuccugagccggaacaagaagccccgcaucugcacgcgggaggaguucacccgcaaggugcgguccaacgccgccaucggcgcgguguucgucgacgagaaccaguggaacagcgccaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggcgaaggggagccgcgccaucugguacauguggcugggcgcccgguuccucgaguucgaggcccugggcuucaugaacgaggaccacugguucucccgcgagaacagccuguccgggguggagggcgaggggcuccacaagcugggcuacauccugcgggacaucagcaagauccccgggggcaacauguacgccgacgacaccgcgggcugggacacgcgcaucaccgaggacgaccuccagaacgaggccaagaucaccgacaucauggagccggagcacgcccugcuggccaccuccaucuucaagcucacguaccagaacaaggugguccgcgugcagcggcccgccaagagcgggaccgugauggacgucaucucccgccgggaccagcgcggcagcggccaggugggcaccuacggccugaacaccuucacgaacauggaggugcagcugauccggcagauggaguccgaggggaucuuccuccccagcgagcuggagacccccaaccuggcggagcgcgcccucgacuggcuggagaagcacggcgucgagcggcugaagcgcauggccaucuccggggacgacugcguggugaagccgaccgacgaccgguucgccaccgcccucacggcgcugaacgacaugggcaagguccgcaaggacaucccccagugggagcccagcaagggguggaacgacuggcagcagguccccuucugcucccaccacuuccaccagcugaucaugaaggacggccgggagaucguggucccgugccgcaaccaggacgagcucgugggccgggcccgcgugagccagggggccggcuggucccugcgggagaccgccugccugggcaagagcuacgcccagauguggcagcucauguacuuccaccgccgggaccugcgccuggcggccaacgccaucugcuccgccguccccguggacugggugcccaccagccggaccaccuggagcauccacgcgcaccaccaguggaugacgaccgaggacaugcucuccgucuggaaccgcguguggaucgaggagaaccccuggauggaggacaagacccacgugagcuccugggaggacgucccguaccugggcaagcgcgaggaccaguggugcgggagccugaucggccucaccgcccgggccacgugggccaccaacauccagguggccaucaaccaggugcgccggcugaucggcaacgagaacuaccuggacuacaugaccuccaugaagcgcuucaagaacgagagcgaccccgagggggcgcucugguga

SEQ ID NO: 7939 - RNA, 9879 nt, Artificial Sequence
  derived and/or modified CDS sequence (opt1) from DENV-1__KT831765__SS-prME
agcgugaccaugcuccucaugcugaugcccaccgcccuggccuuccaccucaccacccggggcggggagccccacaugaucgugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugccccacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggagcacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgagaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaaccaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuaccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaccggcacccuggccguguucuuccugcucaucauggggcagcugacguggaacgaccugauccgccucugcaucauggucggcgcgaacgccagcgaccgcauggggaugggcaccaccuaccuggcccugauggccaccuucaagaugcggccgauguucgccgugggccuccuguuccgccggcugacgucccgcgaggugcuccugcugaccaucgggcucagccuggucgcguccguggagcugcccaacagccucgaggagcugggcgacgggcuggccaugggcaucaugauccucaagcugcugaccgacuuccagucccaccagcucugggccacccugcugagccucacguucaucaagaccaccuucucccugcacuacgccuggaagaccauggcgaugguccugagcaucgugucccucuucccccugugccugagcacgaccucccagaagaccaccuggcuccccgugcugcugggcagccucgggugcaagccgcugacgauguuccugaucgccgagaacaagaucuggggccggaaguccuggccccucaacgaggggaucauggccgucggcaucgugagcauccugcugagcucccuccugaagaacgacgugccccuggccgggccccucaucgccggcggcaugcugaucgcgugcuacgucaucagcggguccagcgccgaccugucccucgagaaggccgccgaggugagcugggaggaggaggccgagcacuccggcgcgagccacaacauccugguggagguccaggacgacgggaccaugaagaucaaggacgaggagcgcgacgacacccugaccauccuccugaaggccacccugcucgccguguccggcguguacccgcugagcauccccgccacgcuguucgucugguacuucuggcagaagaagaagcagcgguccggggugcucugggacacccccagcccgcccgagguggagcgcgccguccuggacgacggcaucuaccggaucaugcagcgcggccugcuggggcggucccaggugggcgugggggucuuccaggagaacguguuccacaccauguggcacgugacccgcggcgcgguccucauguaccaggggaagcggcuggagcccagcugggccuccgugaagaaggaccugaucagcuacggcggcggguggcgccuccagggcuccuggaacacgggggaggaggugcaggucaucgccguggagcccggcaagaaccccaagaacgugcagaccgcccccgggaccuucaagacccccgagggcgaggucggcgccaucgcgcuggacuucaagcccgggacgagcggcucccccaucgugaaccgggaggggaagaucgugggccuguacggcaacggggucgugaccaccagcggcaccuacgugagcgccaucgcccaggccaaggcgucccaggaggggccgcuccccgagaucgaggacgaggucuuccgcaagcggaaccugacgaucauggaccugcaccccggcagcgggaagacccgccgguaccucccggccaucgugcgcgaggccaucaagcggaagcugcgcacccugauccucgcccccacccgcguggucgccuccgagauggcggaggcccugaagggcaugcccauccgguaccagacgaccgccgucaagagcgagcacaccggcaaggagaucguggaccugaugugccacgccaccuucacgaugcgccuccugucccccguccgggugccgaacuacaacaugaucaucauggacgaggcccacuucaccgaccccagcuccaucgcggcccgcggguacaucagcacccgggugggcaugggggaggccgccgccaucuucaugaccgcgacgccgcccggcuccgucgaggccuucccgcagagcaacgccgugauccaggacgaggagcgcgacauccccgagcgguccuggaacagcggguacgaguggaucaccgacuuccccggcaagaccgugugguucguccccuccaucaagagcggcaacgacaucgccaacugccugcgcaagaacgggaagcgggugauccagcucucccgcaagaccuucgacacggaguaccagaagaccaagaacaacgacugggacuacguggucaccaccgacaucagcgagaugggcgcgaacuuccgggccgaccgcgugaucgacccgcggcgcugccugaagcccgugauccugaaggacgggcccgagcgggucauccucgccggccccaugccggugacggucgccuccgccgcgcagcgccgggggcgcaucggccggaaccacaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgcgagaaguccgccgcgaucgacggggaguaccgccugcggggcgaggcccgcaagaccuucguggagcucaugcggcgcggggaccugcccguguggcuguccuacaaggucgccagcgagggcuuccaguacagcgaccggcgcuggugcuucgacggcgagcggaacaaccaggugcucgaggagaacauggacguggagaucuggacgaaggagggggagcgcaagaagcugcggccccgcuggcuggacgcccggaccuacuccgacccccucgcccugcgcgaguucaaggaguucgcggccggccggcgcagcgucuccggggaccugauccucgagaucggcaagcugccgcagcaccugacccagcgggcccagaacgcccucgacaaccuggugaugcugcacaacagcgagcagggcgggcgcgcguaccggcacgccauggaggagcuccccgacaccaucgagacgcugaugcugcucgcccugaucgccgugcugaccggcggggucacccucuucuuccuguccggcaaggggcugggcaagaccagcaucggccuccugugcgugauggccuccagcgugcugcucuggauggcguccgucgagccccacuggaucgccgccagcaucauccuggaguucuuccugauggugcuccugauccccgagccggaccgccagcggacgccccaggacaaccagcuggccuacguggucaucgggaugcuguucaugauccugacgguggccgcgaacgagaugggccugcucgagaccaccaagaaggaccuggggaucggccacguggccgucgagaaccaccaccacgccgccaugcuggacguggaccuccaccccgccuccgcguggacccuguacgccguggccacgaccaucaucaccccgaugaugcgccacaccaucgagaacacgaccgccaacaucagccugaccgccaucgcgaaccaggccgccauccucauggggcuggacaagggcuggcccaucuccaagauggacaucggcgucccccugcucgcccuggggugcuacagccaggugaacccccugacccucacggcggccgugcugaugcuggucgcccacuacgccaucaucggcccggggcuccaggccaaggcgacccgggaggcccagaagcgcaccgccgccggcaucaugaagaaccccaccguggacgggaucguggccaucgaccuggaccccgucguguacgacgcgaaguucgagaagcagcugggccagaucaugcuccugauccugugcacgucccagauccuccugaugcgcaccaccugggcccugugcgagagcaucacccucgccacgggcccccugaccacccugugggagggguccccgggcaaguucuggaacaccacgaucgccgugagcauggccaacaucuuccggggguccuaccucgcgggcgccggccuggccuucagccugaugaagucccucgggggcgggcgccggggcaccggggcccagggcgagacccugggcgagaaguggaagcgccagcugaaccagcucuccaagagcgaguucaacaccuacaagcgguccgggaucauggaggucgaccgcagcgaggcgaaggagggccugaagcgcggggagacgaccaagcacgccgugucccgcggcaccgccaagcugcggugguucguggagcgcaaccucgucaagcccgaggggaaggugaucgaccugggcugcggccgcggcggguggagcuacuacugcgccgggcugaagaaggugaccgaggucaagggguacacgaagggcggccccggccacgaggagcccaucccgauggccaccuacggguggaaccuggugaagcuccacuccggcaaggacguguucuucgugccgcccgagaagugcgacacccugcugugcgacaucggggagagcucccccaacccgaccaucgaggagggccgcacgcuccgggugcugaagaugguggagcccuggcugcgcgggaaccaguucugcaucaagauccucaaccccuacaugcccagcgucguggagacccuggagcagaugcagcggaagcacggcggcaugcuggugcgcaacccgcucucccggaacagcacccacgagauguacugggucuccugcgggaccggcaacaucgugagcgcgaucaacaugaccucccgcaugcugcugaaccgguucacgauggcccaccgcaagcccaccuacgagcgcgacguggaccucggggccggcacccggcacgucaccguggagcccgagguggccaaccuggacaucaucggccagcgcaucgagaacaucaagugcgagcacaagagcacguggcacuacgacgaggacaaccccuacaagaccugggccuaccacggguccuacgaggucaagccgagcggcuccgcgagcagcauggugaacggggucgugaagcugcucaccaagcccugggacgugauccccauggucacccagaucgccaugacggacaccacccccuucggccagcagcggguguucaaggagaagguggacacccgcacgccgaaggccaagcgggggaccgcccagaucauggaggucaccgcccgcuggcuguggggcuuccugucccggaacaagaagccccgcaucugcacccgggaggaguucacgcgcaaggugcggagcaacgcggccaucggcgccguguucgucgacgagaaccaguggaacuccgccaaggaggcgguggaggacgagcgcuucugggaccucgugcaccgggagcgcgagcugcacaagcaggggaagugcgcgaccugcgucuacaacaugaugggcaagcgggagaagaagcugggggaguucggcaaggccaaggggagccgcgccaucugguacauguggcucggcgcccgguuccuggaguucgaggcgcugggcuucaugaacgaggaccacugguucucccgcgagaacagccucuccgggguggagggcgaggggcugcacaagcugggcuacauccuccgggacaucagcaagaucuccgggggcaacauguacgccgacgacaccgccggcugggacacccgcaucacggaggacgaccugcagaacgaggccaagaucaccgagaucauggagcccgagcacgcccagcuggcgaaggccaucuucaagcucaccuaccagaacaaggugguccgggugcagcgcccggccaagaacgggaccgugauggacgucaucagccgccgggaccagcgcggcuccggccagguggggacguacggccugaacaccuucaccaacauggaggcccagcugauccggcagauggagagcgaggggaucuucucccccagcgagcucgagacccccaaccuggccgagcgcgugcuggacuggcucgagaaguacggcgucgagcggcugaagcgcauggcgaucuccggggacgacugcguggugaagcccaucgacgaccgguucgccacggcccugaccgcccucaacgacaugggcaagguccgcaaggacaucccgcagugggagcccagcaagggguggaacgacuggcagcagguccccuucugcucccaccacuuccaccagcugaucaugaaggacggccgggagaucgugguccccugccgcaaccaggacgagcuggugggccgggcccgcgugagccagggggcgggcuggagccuccgggagaccgccugccuggggaaguccuacgcccagauguggcagcugauguacuuccaccgccgggaccuccgccuggccgcgaacgccaucugcagcgccgucccgguggacugggugcccaccucccggacgaccuggagcauccacgcccaccaccaguggaugaccaccgaggacaugcuguccgucuggaaccgcguguggaucgaggagaaccccuggauggaggacaagacgcacaucagcuccugggaggacgugcccuaccucggcaagcgggaggaccaguggugcgggagccugaucggccugaccgcccgcgcgaccugggccaccaacauccaggucgccaucaaccaggugcgccggcucaucggcaacgagaacuaccuggacuacaugaccuccaugaagcgcuucaagaacgagagcgacccggagggggcccugugguga

SEQ ID NO: 7940 - RNA, 9879 nt, Artificial Sequence
  derived and/or modified CDS sequence (opt1) from DENV-1__KP188567__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgcgauggaccugggcgagcucugcgaggacacgaugaccuacaagugcccccggaucaccgaggccgagcccgacgacgucgacugcuggugcaacgccaccgacaccugggugaccuacgggaccugcagccagaccggcgagcaccggcgggacaagcgguccguggcccuggcgccccacgucggccuggggcucgagacgcgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccauccuccgcaagcugugcaucgaggcgaagaucagcaacaccaccacggacucccggugccccacccagggcgaggccacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgccaccaucacgccccaggcgcccacgagcgagauccagcugaccgacuacggggcccucacccuggacugcagcccccggaccggccuggacuucaacgagaugguccuccugacgaugaaggagaaguccuggcuggugcacaagcagugguuccucgaccugccccugcccuggaccuccggggccagcaccagccaggagaccuggaaccgccaggaccuccuggugacguucaagaccgcccacgccaagaagcaggaggucguggugcugggcucccaggagggcgcgaugcacaccgcccucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggccgagacccagcacggcacggugcugguccaggugaaguacgagggcaccgacgcgcccugcaagauccccuuccucacccaggacgagaagggggugacccagaacggccgccugaucacggccaacccgaucgucaccgacaaggagaagcccgugaacaucgagaccgagccgcccuucggggaguccuacaucguggucggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccagguguucggcaccgcguacgggguccuguucuccggcgugagcuggaccaugaagaucgggaucggcauccugcucacguggcugggccugaacucccgcagcaccucccucagcaugaccugcaucgccguggggauggucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggccgacuccccgaagcggcugagcgccgcgaucggcaaggccugggaggagggggucugcggcauccgcagcgccacccggcuggagaacaucauguggaagcagaucuccaacgagcucaacuacauccugcuggagaacgacaugaaguucaccgugguggucggggacgugaacggcauccucgcccaggggaagaagaugaucaagccccagcccauggagcacaaguacagcuggaaguccuggggcaaggccaagaucaucggcgcggacauccagaacacgaccuucaucaucgacgggcccgacaccccggagugccccgacgaccagcgcgccuggaacaucugggagguggaggacuacggcuucgggaucuucaccacgaacaucuggcugaagcugcgggacagccacacccagaugugcgaccaccgccucauguccgccgccaucaaggacagcaaggcgguccacgccgacaugggcuacuggaucgaguccgagaagaacgagaccuggaagcuggcccgggccagcuucaucgaggugaagaccugcaucuggcccaagucccacacgcuguggagcaacggcgugcucgaguccgagauggucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcuaccgggggccgucccugcgcaccaccaccgugacgggcaagaucauccacgaguggugcugccggagcugcacccugccgccccugcgcuuccgcggggaggacggcugcugguacgggauggagauccgccccgugaaggagaaggaggagaaccugguccgguccauggugagcgcgggcuccggcgagguggacagcuucagccucgggauccugugcgucuccauccugaucgaggaggugaugcgcagccgguggucccgcaagaugcucaugaccggcacccuggccguguuccugcuccugaucauggggcagcugacguggaacgaccucauccggcugugcaucauggucggcgccaacgcccuggaccgcauggggaugggcaccaccuaccucgcccugauggccaccuucaagaugcgcccgauguucgccguggggcuccucuuccggcgccugacgagccgggaggugcugcuccugaccgucgggcugucccucguggccagcgucgagcugcccuccagccuggaggagcucggcgacgggcuggccaugggcaucaugaugcugaagcuccugaccgacuuccagccccaccagcuguggaccacgcuccugucccugaccuucauccgcaccagccucucccuggacuacgccuggaagaccauggcgauggcccugagcaucgugucccucuucccccugugccugagcacgaccucccagaagaccaccuggcucccggugcugcugggcagcuucgggugcaagccccucacgauguuccugaucaccgagaacaagaucuggggccggaaguccuggcccaucaacgaggggaucauggccgucggcaucgugagcauccugcucuccagccugcugaagaacgacgugccccucgccgggccgcugaucgcgggcggcaugcugaucgccugcuacgucaucagcggguccagcgccgaccucucccuggagaaggccgccgaggugagcugggaggaggaggcggagcacuccggcaccagccacaacauccugguggagguccaggacgacgggaccaugaagaucaaggacgaggagcgcgacgacacccucacgauccugcugaaggccacccuccuggccguguccggcguguaccccaugagcauccccgccacccuguucgucugguacuucuggcagaagaagaagcagcgguccggggugcugugggacacccccagcccgcccgagguggagcgcgccguccucgacgacggcaucuaccggauccugcagcgcggccugcucgggcggucccaggugggcgugggggucuuccaggacggcguguuccacacgauguggcacgugacccgcggggcgguccugauguaccagggcaagcggcuggagcccagcugggccuccgugaagaaggaccucaucagcuacggcgggggcuggcgcuuccagggguccuggaacaccggcgaggaggugcaggucaucgccguggagcccgggaagaacccgaagaacgugcagaccacgcccggcaccuucaagacccccgagggcgaggucggggccaucgcccuggacuucaagcccggcaccagcggguccccgaucgugaaccgggagggcaagaucgugggccuguacgggaacggcgucgugacgaccagcgggaccuacguguccgcgaucgcccaggccaaggccacccaggagggcacgcuccccgagaucgaggacgaggucuucaagaagcgcaaccugaccaucauggaccugcaccccgggagcggcaagacccggcgcuaccucccggccaucgugcgggaggcgaucaagcgcaagcugcggacccugauccucgcccccacgcgcguggucgccagcgagauggccgaggcgcugaagggcaugcccauccgcuaccagaccaccgccgugaaguccgagcacaccgggcgggagaucguggaccugaugugccacgccacguucaccaugcgccuccugagccccguccgggugccgaacuacaacaugaucaucauggacgaggcccacuucaccgaccccgccuccaucgcggcccgcggcuacaucagcacccggguggggaugggcgaggccgccgccaucuucaugacggcgacgccgcccggguccgucgaggccuucccgcagagcaacgccgugauccaggacgaggagcgcgacauccccgagcgguccuggaacagcggcuacgacuggaucaccgacuuccccggcaagaccgugugguucguccccuccaucaagagcgggaacgacaucgccaacugccugcgcaagaacggcaagcgggugauccagcucucccgcaagacguucgacaccgaguaccagaagaccaagaacaacgacugggacuacguggucaccacggacaucagcgagaugggggccaacuuccgggcggaccgcgugaucgacccgcggcgcugccugaagcccgugauccugaaggagggccccgagcgggucauccucgccgggcccaugccggugaccgucgccuccgccgcgcagcgccggggccgcaucggccggaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgcgagaaguccgccgcgaucgacggcgaguaccgccugcgcggggaggcccgcaagacguucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcccugcgcgaguucaaggaguucgcggccgggcggcgcuccgucagcggcgaccugauccucgagaucggcaagcugccgcagcaccugacccuccgggcccagaacgcccuggacaaccuggugaugcuccacaacagcgagcagggcgggaaggccuaccgccacgcgauggaggagcugcccgacaccaucgagacgcugaugcuccuggcccugaucgccgugcucaccgggggcgucacccuguucuuccuguccgggaagggccucggcaagaccagcaucgggcugcugugcgugauggccuccagcgcgcuccuguggauggccuccguggagccccacuggaucgccgccagcaucauccuggaguucuuccucaugguccugcugauccccgagccggaccggcagcgcacgccccaggacaaccagcucgccuacguggugaucggccugcuguucaugauccucaccgucgcggccaacgagauggggcugcuggagaccaccaagaaggaccucggcaucgggcacguggccguggagaaccaccaccacgccacgaugcuggacgucgaccugcggcccgccuccgcguggacccucuacgccguggccaccaccgugaucacgccgaugaugcgccacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgggaggcccagaagcgcacggccgccgggaucaugaagaaccccaccguggacggcaucgugaccaucgaccucgaccccgucguguacgacgccaaguucgagaagcagcugggccagaucaugcugcucauccugugcaccucccagauccugcucaugcgcacgaccugggcgcugugcgagagcaucacccuggccaccgggccccucacgacccugugggagggcuccccggggaaguucuggaacaccaccaucgccgugagcauggccaacaucuuccggggcuccuaccuggccggcgcggggcucgccuucagccugaugaagucccugggcgggggccgccgggggacgggcgcccagggcgagacccucggggagaaguggaagcgccagcugaaccagcugagcaaguccgaguucaacaccuacaagaaguccggcaucauggaggucgaccggagcgaggccaaggaggggcugaagcgcggcgagaccacgaagcacgccgugucccgggggaccgcgaagcuccgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaaccuggugaagcugcacuccgggaaggacguguucuucacgccgcccgagaagugcgacacccuccugugcgacaucggcgagagcucccccaacccgaccaucgaggaggggcggacccugcgcguccucaagaugguggagcccuggcugcggggcaaccaguucugcaucaagauccugaaccccuacaugcccagcguggucgagacgcucgagcagaugcagcgcaagcacggcgggaugcuggugcggaacccgcugucccgcaacagcacccacgagauguacuggguguccugcggcaccgggaacaucgucagcgccgugaacaugaccucccggaugcuccugaaccgcuucacgauggcgcaccggaagcccaccuacgagcgcgacguggaccugggcgccggcacccgccacgucgccguggagcccgagguggccaaccucgacaucaucgggcagcggaucgagaacaucaagaacgagcacaagagcaccuggcacuacgacgaggacaaccccuacaagacgugggccuaccacggcuccuacgaggucaagccgagcggguccgcgagcuccauggugaacggcgucgugcgccugcugaccaagcccugggacgugauccccauggucacccagaucgccaugaccgacacgacccccuucgggcagcagcggguguucaaggagaagguggacacccgcaccccgcgggccaagcgcggcacggcccagaucauggaggucaccgccaaguggcucuggggcuuccugagccggaacaagaagccccgcaucugcacccgggaggaguucacccgcaaggugcgguccaacgcggccaucggggccguguucgucgacgagaaccaguggaacagcgccaaggaggccguggaggacgagcgcuucugggaccuggugcaccgggagcgcgagcuccacaagcagggcaagugcgcgacgugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacccgcaucaccgaggacgaccuccagaacgaggccaagaucacggacaucauggagccggagcacgcccugcuggcgaccuccaucuucaagcucaccuaccagaacaaggugguccgggugcagcgccccgccaagagcggcaccgugauggacgucaucucccgccgggaccagcgcgggagcggccaggugggcacguacgggcugaacaccuucaccaacauggaggugcagcugauccggcagauggaguccgagggcaucuucagccccuccgagcucgagacccccaaccuggccaagaagguccuggacuggcucgagaagcacggggccgagcgccugaagcggauggccaucagcggcgacgacugcguggugaagccgaucgacgaccgcuucgcgacggcccugaccgcccucaacgacauggggaagguccggaaggacaucccccagugggagcccuccaagggcuggaacgacuggcagcagguccccuucugcagccaccacuuccaccagcugaucaugaaggacggccgcgagaucguggucccgugccggaaccaggacgagcugguggggcgcgcccgggugucccagggcgccggguggagccuccgcgagaccgcgugccugggcaaguccuacgcccagauguggcagcugauguacuuccaccggcgcgaccuccggcuggccgccaacgccaucugcagcgcgguccccgccgacugggugcccaccagccgcaccacgugguccauccacgcccaccaccaguggaugaccaccgaggacaugcugagcguguggaaccgggucuggaucgaggagaaccccuggauggaggacaagacccacguguccagcugggaggaggugccguaccucgggaagcgcgaggaccaguggugcggcucccugaucggccugacggcccgggcgaccugggccaccaacauccaggucgccaucaaccaggugcgccgccucaucgggaacgagaacuaccuggacuacaugaccagcaugaagcgguucaagaacgaguccgaccccgagggcgcccugugguga

SEQ ID NO: 7941 - RNA, 9879 nt, Artificial Sequence
  derived and/or modified CDS sequence (opt1) from DENV-1__KP188568__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgcgauggaccugggcgagcucugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccuggcgccccacgucggccuggggcucgagacgcgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgugacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaaccacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagauggugauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgagauggacagcuucagccucgggauccugugcgucuccauccugaucgaggaggugaugcggagccgcuggucccggaagaugcucaugaccggcacccuggccguguucuuccugcucaucauggggcagcugacguggaacgaccugauccgccucugcaucauggucggcgccaacgccagcgaccgcauggggaugggcaccaccuaccuggcccugauggccaccuucaagaugcggccgauguucgccguggggcuccuguuccgccggcugacgucccgcgaggugcuccugcugaccgucgggcucagccugguggccuccgucgagcugcccaacagccucgaggagcugggcgacgggcuggccaugggcaucaugaugcucaagcugcugaccgacuuccagccccaccagcucuggaccacgcugcugucccucaccuucauccggaccagccugucccuggacuacgccuggaagaccauggcgauggcccucagcaucgugucccuguucccccugugccucagcacgaccucccagaagaccaccuggcugccggugcugcucggcagcuucgggugcaagccccugacgauguuccugaucaccgagaacaagaucuggggccgcaaguccuggcccaucaacgaggggaucauggccgucggcaucgugagcauccuccuguccagccugcucaagaacgacgugccccuggccgggccgcugaucgcgggcggcaugcucaucgccugcuacgucaucagcggguccagcgccgaccugucccuggagaaggccgccgaggugagcugggaggaggaggcggagcacuccggcaccagccacaacauccucguggagguccaggacgacgggaccaugaagaucaaggacgaggagcgggacgacacccugacgauccugcucaaggccacccugcuggccguguccggcguguaccccaugagcauccccgccacccucuucgucugguacuucuggcagaagaagaagcagcgcuccggggugcugugggacacccccagcccgcccgagguggagcgggccguccuggacgacggcaucuaccgcauccugcagcggggccuccuggggcgcucccaggugggcgugggggucuuccaggacggcguguuccacacgauguggcacgugacccgcggggcgguccugauguaccagggcaagcgccucgagcccagcugggccuccgugaagaaggaccugaucagcuacggcgggggcuggcgguuccagggguccuggaacaccggcgaggaggugcaggucaucgccguggagcccgggaagaacccgaagaacgugcagaccacgcccggcaccuucaagacccccgagggcgaggucggggccaucgcccuggacuucaagcccggcaccagcggguccccgaucgugaaccgcgagggcaagaucgugggccucuacgggaacggcgucgugacgaccagcgggaccuacguguccgcgaucgcccaggccaaggccacccaggagggcccccugcccgagaucgaggacgaggucuucaagaagcggaaccugacgaucauggaccuccacccggggagcggcaagacccgccgguaccugcccagcaucgugcgcgaggccaucaagcggaagcugcgcacccucauccuggcgcccacccgcguggucgccuccgagauggccgaggcccugaagggcaugcccauccgguaccagacgaccgcggucaagagcgagcacaccgggcgcgagaucguggaccucaugugccacgccaccuucacgaugcggcugcuguccccgguccgcgugcccaacuacaacaugaucaucauggacgaggcccacuucaccgaccccgccagcaucgccgcgcggggcuacaucuccacccgcguggggaugggcgaggccgccgccaucuucaugaccgccacgcccccggggagcgucgaggcguucccccaguccaacgccgccauccaggacgaggagcgggacauccccgagcgcagcuggaacaccggcuacgacuggaucaccgacuuccccggcaagaccgugugguucgugccguccaucaagagcgggaacgacaucgccaacugccuccggaagaacggcaagcgcgucauccagcugucccggaagacguucgacaccgaguaccagaagaccaagaacaacgacugggacuacguggugaccacggacaucagcgagaugggggccaacuuccgcgcggaccgggucaucgacccccgccggugccugaagcccgugauccucaaggagggccccgagcgcgugauccuggccgggccgaugcccgucaccguggccuccgccgcgcagcggcgcggccggaucggccgcaaccagaacaaggagggggaccaguacaucuacaugggccagccccugaacaacgacgaggaccacgcccacuggaccgaggccaagaugcuccuggacaacaucaacacccccgaggggaucaucccggcccuguucgagcccgagcgcgagaaguccgccgcgaucgacggcgaguaccggcuccgcggggaggcccggaagacguucgucgagcugaugcgccggggcgaccugcccguguggcucuccuacaagguggccagcgagggcuuccaguacuccgaccgccgguggugcuucgacggggagcgcaacaaccagguccuggaggagaacauggacguggagaucuggaccaaggagggcgagcggaagaagcugcgcccccgguggcucgacgcccgcaccuacagcgacccgcuggcccugcgggaguucaaggaguucgcggccgggcgccgguccgugagcggcgaccucauccuggagaucggcaagcugccccagcaccucacccugcgcgcccagaacgcccuggacaaccucgucaugcugcacaacagcgagcagggcgggaaggccuaccggcacgcgauggaggagcugcccgacaccaucgagacgcucaugcugcuggcccucaucgccgugcugaccgggggcgugacccuguucuuccucuccgggaagggccugggcaagaccagcaucgggcugcucugcgucauggccuccagcgcgcugcuguggguggccuccguggagccccacuggaucgccgccagcaucauccucgaguucuuccugaugguccugcucaucccggagcccgaccgccagcggacgccccaggacaaccagcuggccuacguggugaucggccuccucuucaugauccugaccgucgcggccaacgagauggggcugcucgagaccaccaagaaggaccugggcaucgggcacguggccguggagaaccaccaccacgccacgaugcuggacgucgaccuccgcccggccuccgcguggacccuguacgccguggccaccaccgugaucacgcccaugaugcggcacaccaucgagaacaccaccgccaacaucagccugacggccaucgcgaaccaggccgccauccucaugggccuggacaagggcuggcccaucuccaagauggacaucggggucccccugcucgcccugggcugcuacagccaggugaacccgcugacccucaccgccgcggugcugaugcuggucgcccacuacgccaucaucgggcccggccuccaggccaaggcgacccgcgaggcccagaagcgcacggccgccgggaucaugaagaaccccaccguggacggcaucgugaccaucgaccuggaccccgucguguacgacgccaaguucgagaagcagcugggccagaucaugcuccugauccugugcaccucccagauccuccugaugcggacgaccugggcgcugugcgagagcaucacccucgccaccgggccgcugacgacccugugggagggcucccccgggaaguucuggaacaccaccaucgccgugagcauggccaacaucuuccgcggcuccuaccucgccggcgcggggcuggccuucagcgucaugaagucccugggcgggggccggcgcgggacgggcgcccagggcgagacccucggggagaaguggaagcggcagcugaaccagcugagcaaguccgaguucaacaccuacaagaaguccggcaucauggagguggaccgcagcgaggccaaggaggggcucaagcggggcgagaccacgaagcacgccgugucccgcgggaccgcgaagcugcggugguucgucgagcgcaaccuggugaagcccgagggcaaggugaucgaccugggcugcgggcggggcggguggagcuacuacugcgccggccucaagaaggucaccgaggugaagggguacaccaagggcggccccgggcacgaggagccgauccccauggccaccuacggcuggaaccuggugaagcugcacuccgggaaggacgucuucuucacgccgcccgagaagugcgacacccuccugugcgacaucggcgagagcuccccgaaccccaccaucgaggaggggcgcacccugcgggugcucaagaugguggagcccuggcugcgcggcaaccaguucugcaucaagauccugaaccccuacaugccgagcgucguggagacgcucgagcagaugcagcggaagcacggcgggaugcuggugcgcaacccccugucccggaacagcacccacgagauguacugggucuccugcggcaccgggaacaucgugagcgccgugaacaugaccucccgcaugcuccugaaccgguucacgauggcgcaccgcaagcccaccuacgagcgcgacgucgaccugggcgccggcacccggcacguggccguggagcccgaggucgccaaccucgacaucaucgggcagcgcaucgagaacaucaagaacgagcacaagagcaccuggcacuacgacgaggacaacccguacaagacgugggccuaccacggcuccuacgaggugaagcccagcggguccgcgagcuccauggucaacggcguggugcggcugcugaccaagcccugggacgucauccccauggugacccagaucgccaugaccgacacgaccccguucgggcagcagcgcguguucaaggagaaggucgacacccggacgccccgggccaagcggggcacggcccagaucauggaggugaccgccaaguggcucuggggcuuccugagccgcaacaagaagccccggaucugcacccgcgaggaguucacccggaaggugcgcuccaacgcggccaucggggccgucuucguggacgagaaccaguggaacagcgccaaggaggccguggaggacgagcgguucugggaccugguccaccgcgagcgggagcuccacaagcagggcaagugcgcgacgugcguguacaacaugauggggaagcgcgagaagaagcugggcgaguucgggaaggccaagggcagccgggccaucugguacauguggcugggcgcccgcuuccucgaguucgaggcgcugggguucaugaacgaggaccacugguucucccgggagaacagccuguccggcguggagggggagggccuccacaagcugggguacauccugcgcgacaucagcaagaucccgggcggcaacauguacgccgacgacaccgccgggugggacacccggaucaccgaggacgaccuccagaacgaggccaagaucacggacaucauggagcccgagcacgcccugcuggcgaccuccaucuucaagcucaccuaccagaacaaggucgugcgcgugcagcgccccgccaagagcggcaccgucauggacgugaucucccggcgcgaccagcgggggagcggccaggugggcacguacgggcugaacaccuucaccaacauggagguccagcugauccgccagauggaguccgagggcaucuucagccccuccgagcucgagaccccgaaccuggccaagaaggugcuggacuggcucgagaagcacggggccgagcggcugaagcgcauggccaucagcggcgacgacugcguggucaagcccaucgacgaccgguucgcgacggcccugaccgcccucaacgacauggggaaggugcgcaaggacaucccccagugggagcccuccaagggcuggaacgacuggcagcaggucccguucugcagccaccacuuccaccagcugaucaugaaggacggccgggagaucgucgugcccugccgcaaccaggacgagcugguggggcgggcccgcgucucccagggcgccggguggagccuccgggagaccgcgugccugggcaaguccuacgcccagauguggcagcugauguacuuccaccgccgggaccuccgccuggccgccaacgccaucugcagcgcggugcccguggacuggguccccaccagccggaccacgugguccauccacgcccaccaccaguggaugaccaccgaggacaugcugagcguguggaaccgcguguggaucgaggagaacccguggauggaggacaagacccacgucuccagcugggaggaggugcccuaccucgggaagcgggaggaccaguggugcggcucccugaucggccugacggcccgcgccaccugggcgaccaacauccagguggccaucaaccagguccgccggcucaucgggaacgagaacuaccuggacuacaugaccagcaugaagcgcuucaagaacgaguccgaccccgagggcgcccugugguga

SEQ ID NO: 7942 - RNA, 9879 nt, Artificial Sequence
  derived and/or modified CDS sequence (opt1) from DENV-1__KF971870__SS-prME
agcgugaccaugcugcucaugcugaugcccaccgcccuggccuuccaccucaccacccggggcggggagccccacaugaugguguccaagcaggagcggggcaagagccugcuguucaagaccuccgcgggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccagcgccaucaaggacuccaaggccgugcacgccgacaugggcuacuggaucgagagcgagaagaacgacaccuggaagcuggcccgggcguccuucaucgaggucaagaccugcaucuggcccaagagccacacgcugugguccaacggcgugcucgagagcgagaugaucauccccaagaucuacgggggcccgaucucccagcacaacuaccgccccggguacuucacccagaccgccggccccuggcaccuggggaagcuggagcucgacuucgaccugugcgagggcaccacgguggucguggacgagcacugcggcaaccgggggccgagccugcgcaccaccaccgugacgggcaagaucauccacgaguggugcugccgguccugcacccugccgccccuccgcuuccgcggggaggacggcugcugguacgggauggagauccgccccgucaaggagaaggaggagaaccuggugaaguccauggugagcgccggcuccggcgaggucgacagcuucucccucgggcugcugugcaucagcaucaugaucgaggaggugaugcggucccgcuggagccggaagaugcucaugaucggcacccuggccguguucuuccugcucaucauggggcagcugaccuggaacgaccugauccgccucugcaucauggucggcgccaacgcguccgaccgcauggggaugggcacgaccuaccuggcccugauggccaccuucaagaugcggccgauguucgccgugggccuccuguuccgccggcugaccagccgcgaggugcuccugcugacgaucgggcucucccuggucgccagcgcggagcugcccaacucccucgaggagcugggcgacgggcuggccaugggcaucaugauccucaagcugcugaccgacuuccagagccaccagcucugggccacccugcugucccucaccuucaucaagacgaccuucagccugcacuacgccuggaagaccauggcgauggugcuguccaucgucagccucuucccccugugccuguccaccacgagccagaagaccaccuggcuccccgugcugcugggcucccucgggugcaagccgcugaccauguuccugaucgccgagaacaagaucuggggccgcaagagcuggccccucaacgaggggaucauggccgugggcaucgucagcauccugcuguccagccuccugaagaacgacgugccccuggccgggccccucaucgccggcggcaugcugaucgcgugcuacgugaucuccgggagcuccgccgaccugagccucgagaaggccgccgaggucuccugggaggaggaggccgagcacagcggcgcgucccacaacauccugguggaggugcaggacgacgggacgaugaagaucaaggacgaggagcgcgacgacacccugaccauccuccugaaggccacccugcucgccgucagcggcguguucccgcuguccauccccgccacccuguucgugugguacuucuggcagaagaagaagcagcggagcgggguccucugggacacgcccagcccgcccgagguggagcgcgccgugcuggacgacggcaucuaccggaucaugcagcgcggccugcuggggcggagccaggucggcguggggguguuccaggagaacgucuuccacaccauguggcacgugacccgcggcgcggugcucauguaccaggggaagcggcuggagcccuccugggccagcgucaagaaggaccugaucuccuacggcggcggguggcgccuccagggcagcuggaacaccggggaggagguccaggugaucgccgucgagcccggcaagaaccccaagaacgugcagacggcccccgggaccuucaagacccccgagggcgaggugggcgccaucgcgcuggacuucaagcccgggaccuccggcagccccaucgucaaccgggaggggaagaucgugggccuguacggcaacgggguggucacgaccagcggcaccuacguguccgccaucgcccaggccaaggcgagccaggaggggccgcuccccgagaucgaggacgagguguuccgcaagcggaaccugaccaucauggaccugcaccccggcuccgggaagacgcgccgguaccucccggccaucguccgcgaggccaucaagcggaagcugcgcacccugauccucgcccccacccgcgugguggccagcgagauggcggaggcccugaagggcaugcccauccgguaccagaccacggccgucaaguccgagcacaccggcaaggagaucguggaccugaugugccacgccaccuucaccaugcgccuccugagccccgugcgggucccgaacuacaacaugaucaucauggacgaggcccacuucacggaccccuccagcaucgcggcccgcggguacaucuccacccgggugggcaugggggaggccgccgccaucuucaugaccgcgacgccgcccggcagcguggaggccuucccgcaguccaacgccgucauccaggacgaggagcgcgacauccccgagcggagcuggaacuccggguacgaguggaucacggacuuccccggcaagaccgugugguucgugcccagcaucaaguccggcaacgacaucgccaacugccugcgcaagaacgggaagcgggucauccagcucagccgcaagaccuucgacaccgaguaccagaagacgaagaacaacgacugggacuacguggugaccaccgacaucuccgagaugggcgcgaacuuccgggccgaccgcgucaucgacccgcggcgcugccugaagcccgugauccugaaggacgggcccgagcgggugauccucgccggccccaugccggucaccguggccagcgccgcgcagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgccgcgaucgacggggaguaccgccugcggggcgaggcccgcaagaccuucgucgagcucaugcggcgcggggaccugcccguguggcugagcuacaagguggccagcgagggcuuccaguacuccgaccggcgcuggugcuucgacggcgagcggaacaaccagguccucgaggagaacauggacguggagaucuggaccaaggagggggagcgcgagaagcugcggccccgcuggcugggcgcccggacguacagcgacccccucgcccugcgcgacuucaaggaguucgcggccgggcggcgcuccgugagcggcgaccugauccucgagaucggcaagcugccgcagcaccugacccagcgggcccagaacgcccucgacaaccuggucaugcugcacaacucccagcagggcgggcgcgcguacacccacgccauggaggagcuccccgacaccaucgagacgcugaugcugcucgcccugaucgccgugcugaccgggggcgugacccucuucuuccugagcgggcggggccugggcaagaccuccaucgggcuccugugcgucauggccagcuccgugcugcucuggauggcgagcguggagccccacuggaucgccgccuccaucauccuggaguucuuccugaugguccuccugauccccgagccggaccgccagcggacgccccaggacaaccagcuggccuacguggugaucggccuccuguucaugauccugacggucgccgcgaacgagauggggcuccuggagaccaccaagaaggaccugggcaucgggcacguggccguggagaaccaccaccacgccgccaugcucgacgucgaccugcaccccgccagcgcguggacccuguacgccguggccacgaccaucaucaccccgaugaugcgccacaccaucgagaacacgaccgccaacaucucccucaccgccaucgcgaaccaggccgccauccugaugggccuggacaagggcuggcccaucagcaagauggacaucggggugccccuccuggcccugggcugcuacucccaggucaacccccucacccugacggcggccgugcugaugcucguggcccacuacgccaucaucgggccgggccugcaggccaaggcgacccgggaggcccagaagcgcaccgccgccgggaucaugaagaaccccaccgucgacggcaucguggccaucgaccuggaccccguggucuacgacgcgaaguucgagaagcagcucggccagaucaugcugcugauccucugcacgagccagauccugcugaugcgcaccaccugggcccucugcgaguccaucacccuggccacggggccccugaccacccucugggagggcagcccggggaaguucuggaacaccacgaucgccguguccauggccaacaucuuccggggcagcuaccuggcgggcgccgggcuggccuucagccucaugaagucccugggcgggggccgccgggggaccggcgcccagggcgagacccugggggagaaguggaagcgccggcucaaccagcugagcaaguccgaguucaacaccuacaagcgcagcggcaucauggagguggaccgguccgaggcgaaggaggggcugaagcgcggcgagacgaccaagcacgccgucagccgggggaccgccaagcuccgcugguucguggagcggaaccuggugaagcccgagggcaaggucaucgaccugggcugcgggcgcggcgggugguccuacuacugcgccggccugaagaaggugaccgaggugaagggguacacgaagggcggccccgggcacgaggagcccaucccgauggccaccuacggcuggaaccucgucaagcugcacagcgggaaggacguguucuucaucccgcccgagaagugcgacacccugcucugcgacaucggcgaguccagccccaacccgaccaucgaggaggggcggacgcugcgcgugcugaagauggucgagcccuggcuccggggcaaccaguucugcaucaagauccugaaccccuacaugcccuccgugguggagacccuggagcagaugcagcgcaagcacggcgggaugcucguccggaacccgcugagccgcaacuccacccacgagauguacugggugagcugcggcaccgggaacaucguguccgcggucaacaugaccagccggaugcugcucaaccgcuucacgauggcccaccgcaagcccaccuacgagcgggacguggaccugggcgccggcacccgccacguggccgucgagcccgagguggccaaccuggacaucaucgggcagcggaucgagaacaucaagcacgagcacaaguccaccuggcacuacgacgaggacaaccccuacaagacgugggcguaccacggcagcuacgaggugaagccguccgggagcgccagcuccauggucaacggcguggucaagcuccugaccaagcccugggacgugauccccauggugacccagaucgccaugaccgacacgacccccuucgggcagcagcgcgucuucaaggagaagguggacacccggaccccgaaggccaagcgcggcacggcccagaucauggaggugaccgcgcgguggcuguggggcuuccucagccgcaacaagaagccccggaucugcacccgcgaggaguucacccggaagguccgcuccaacgccgccaucggggccguguucaucgacgagaaccaguggaacagcgcgaaggaggccguggaggacgagcgguucugggaccugguccaccgcgagcgggagcugcacaagcagggcaagugcgccacgugcguguacaacaugauggggaagcgcgagaagaagcucggcgaguucgggaaggccaagggcucccgggccaucugguacauguggcugggcgcgcgcuuccuggaguucgaggcccucggguucaugaacgaggaccacugguucagccgggagaacucccugagcggcguggagggggagggccugcacaagcucggguacauccugcgcgacaucuccaagauccccggcggcaacauguacgccgacgacaccgccgggugggacacccggaucaccgaggacgaccugcagaacgaggccaagaucacggacaucauggagccggagcacgcgcuccuggccaaggccaucuucaagcugaccuaccagaacaaggucgugcgcgugcagcgccccgccaagaacggcaccgucauggacgugaucagccggcgcgaccagcggggguccggccaggugggcaccuacgggcucaacacguucaccaacauggaggcccagcugauccgccagauggagagcgagggcaucuucucccccagcgagcuggagacccccaaccucgcggagcggguccuggacuggcuggggaaguacggcguggagcgccucaagcggauggccaucuccggggacgacugcguggucaagccgaucgacgaccgcuucgccaccgcccugacggcccugaacgacaugggcaaggugcggaaggacaucccccagugggagcccagcaagggcuggaacgacuggcagcagguccccuucugcucccaccacuuccaccagcucaucaugaaggacgggcgcgagaucgucgugccgugccggaaccaggacgagcuggugggccgcgcgcgggucagccagggggccggcuggagccugcgcgagaccgccugccucgggaaguccuacgcccagauguggcagcugauguacuuccaccggcgcgaccugcggcucgcggccaacgccaucugcagcgccgugcccguggacuggguccccaccucccgcaccacguggagcauccacgcccaccaccaguggaugaccaccgaggacaugcuguccguguggaaccggguguggaucgaggagaaccccuggauggaggacaagacccacaucagcaacugggaggacgucccguaccugggcaagcgcgaggaccaguggugcggcucccucaucgggcugacggcgcgcgccaccugggccaccaacauccagguggccaucaaccaggugcggcgccugaucggcaacgagaacuaccucgacuacaugaccagcaugaagcgguucaagaacgaguccgaccccgagggggcccugugguga

SEQ ID NO: 7943 - RNA, 9879 nt, Artificial Sequence
  derived and/or modified CDS sequence (opt1) from DENV-1__KF971871__SS-prME
agcgugaccaugcugcucaugcugaugcccaccgcccuggccuuccaccucaccacccggggcggggagccccacaugauggugagcaagcaggagcggggcaagagccugcuguucaagaccagcgccggggugaacaugugcacccucaucgccauggaccugggcgagcugugcgaggacaccaugaccuacaagugcccccgcaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcggguggagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgacaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaucggcacccuggccguguucuuccugcucaucauggggcagcugaccuggaacgaccugauccgccucugcaucauggucggcgcgaacgccagcgaccgcauggggaugggcacgaccuaccuggcccugauggccaccuucaagaugcggccgauguucgccgugggccuccuguuccgccggcugaccucccgcgaggugcuccugcugacgaucgggcucagccuggucgcguccgccgagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucuucccccugugccugagcaccacgucccagaagaccaccuggcuccccgugcugcugggcagccucgggugcaagccgcugaccauguuccugaucgccgagaacaagaucuggggccggaaguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggacgaugaagaucaaggacgaggagcgcgacgacacccugaccauccuccugaaggccacccugcucgccgucuccggcguguucccgcugagcauccccgccacccuguucgugugguacuucuggcagaagaagaagcagcgguccgggguccucugggacacgcccagcccgcccgagguggagcgcgcggugcuggacgacggcaucuaccggaucaugcagcgcggccugcuggggcggucccaggucggcguggggguguuccaggagaacgucuuccacaccauguggcacgugacccgcggcgccgugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgggaggggaagaucgugggccuguacggcaacgggguggucacgaccagcggcaccuacgugagcgccaucgcccaggcgaaggccucccaggaggggccgcuccccgagaucgaggacgagguguuccgcaagcggaaccugaccaucauggaccugcaccccggcagcgggaagacgcgccgguaccucccggccaucguccgcgaggccaucaagcggaagcugcgcacccugauccucgcccccacccgcgugguggcguccgagauggccgaggcccugaagggcaugcccauccgguaccagaccacggccgucaagagcgagcacaccggcaaggagaucguggaccugaugugccacgccaccuucaccaugcgccuccugucccccgugcgggucccgaacuacaacaugaucaucauggacgaggcgcacuucacggaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucacggacuuccccggcaagaccgugugguucgugcccuccaucaagagcggcaacgacaucgcgaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucaccguggccuccgcggcccagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgcggccaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcugggcgcccggacguacuccgacccccucgcgcugcgcgaguucaaggaguucgccgccgggcggcgcagcguguccggcgaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacccugaugcugcucgcccugaucgccgugcugaccggcggggugacccucuucuuccuguccgggcgcgggcugggcaagaccagcaucgggcuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucggccuccuguucaugauccugaccgucgcggccaacgagauggggcuccuggagacgaccaagaaggaccugggcaucgggcacguggccguggagaaccaccaccacgccgccaugcucgacgucgaccugcaccccgcguccgccuggacccuguacgccguggccaccacgaucaucaccccgaugaugcggcacaccaucgagaacaccacggccaacaucagccucaccgcgaucgccaaccaggccgccauccugaugggccuggacaagggcuggcccaucuccaagauggacaucggggugccccuccuggcgcugggcugcuacagccaggucaacccccucacccugaccgccgccgugcugaugcucguggcccacuacgccaucaucgggccgggccugcaggcgaaggccacgcgcgaggcccagaagcgcaccgccgccgggaucaugaagaaccccaccgucgacggcaucguggcgaucgaccuggaccccguggucuacgacgccaaguucgagaagcagcucggccagaucaugcugcugauccucugcaccucccagauccugcugaugcggacgaccugggcccucugcgagagcaucacccuggccaccgggccccugacgacccucugggagggcuccccggggaaguucuggaacaccaccaucgccgugagcauggcgaacaucuuccgcggcuccuaccuggccggcgccgggcuggccuucagccucaugaagucccugggcgggggccggcgcgggacgggcgcgcagggcgagacccugggggagaaguggaagcggcgccucaaccagcuguccaagagcgaguucaacaccuacaagcgguccggcaucauggagguggaccgcagcgaggccaaggaggggcugaagcggggcgagaccacgaagcacgccgucucccgcgggaccgccaagcuccggugguucguggagcgcaaccuggugaagcccgagggcaaggucaucgaccugggcugcgggcggggcggguggagcuacuacugcgccggccugaagaaggugaccgaggugaagggguacaccaagggcggccccgggcacgaggagcccaucccgauggcgacguacggcuggaaccucgucaagcugcacuccgggaaggacguguucuucaucccgcccgagaagugcgacacccugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacgcuggagcagaugcagcggaagcacggcgggaugcucguccgcaacccgcugucccggaacagcacccacgagauguacuggguguccugcggcaccgggaacaucgugagcgccgucaacaugaccucccgcaugcugcucaaccgcuucaccauggcccaccggaagcccacguacgagcgcgacguggaccugggcgccggcacccggcacguggccgucgagcccgagguggcgaaccuggacaucaucgggcagcgcaucgagaacaucaagcacgagcacaagagcaccuggcacuacgacgaggacaaccccuacaagaccugggccuaccacggcuccuacgaggugaagccgagcggguccgccagcagcauggucaacggcguggucaagcuccugacgaagcccugggacgugauccccauggugacccagaucgccaugaccgacaccacgcccuucgggcagcagcgggucuucaaggagaagguggacacccgcaccccgaaggccaagcggggcaccgcgcagaucauggaggugacggcccgcuggcuguggggcuuccucucccggaacaagaagccccgcaucugcacccgggaggaguucacccgcaagguccggagcaacgccgccaucggggcgguguucaucgacgagaaccaguggaacuccgccaaggaggccguggaggacgagcgcuucugggaccugguccaccgggagcgcgagcugcacaagcagggcaagugcgcgaccugcguguacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcguggagggggagggccugcacaagcucggguacauccugcgggacaucagcaagauccccggcggcaacauguacgccgacgacacggccgggugggacacccgcaucaccgaggacgaccugcagaacgaggcgaagaucaccgacaucauggagccggagcacgcccuccuggccaaggccaucuucaagcugacguaccagaacaaggucgugcgcgugcagcggcccgccaagaacggcaccgucauggacgugaucucccgccgggaccagcgcgggagcggccaggugggcaccuacgggcucaacaccuucacgaacauggaggcgcagcugauccggcagauggaguccgagggcaucuucagccccuccgagcuggagacccccaaccucgccgagcgcguccuggacuggcuggggaaguacggcguggagcggcucaagcgcauggccaucagcggggacgacugcguggucaagccgaucgacgaccgguucgccaccgcccugaccgcgcugaacgacaugggcaaggugcgcaaggacaucccccagugggagcccuccaagggcuggaacgacuggcagcagguccccuucugcagccaccacuuccaccagcucaucaugaaggacgggcgggagaucgucgugccgugccgcaaccaggacgagcuggugggccgggcccgcgucucccagggggccggcuggagccugcgggagacggccugccucggcaagagcuacgcgcagauguggcagcugauguacuuccaccgccgggaccugcgccucgccgccaacgccaucugcuccgccgugcccguggacuggguccccaccagccggaccaccugguccauccacgcgcaccaccaguggaugacgaccgaggacaugcugagcguguggaaccgcguguggaucgaggagaaccccuggauggaggacaagacccacaucuccaacugggaggacgucccguaccugggcaagcgcgaggaccaguggugcggcagccucaucgggcugaccgcccgggccacgugggccaccaacauccagguggccaucaaccaggugcgccggcugaucggcaacgagaacuaccucgacuacaugaccuccaugaagcgcuucaagaacgagagcgaccccgagggggcgcugugguga

SEQ ID NO: 7944 - RNA, 9879 nt, Artificial Sequence
  derived and/or modified CDS sequence (opt1) from DENV-1__KF971869__SS-prME
agcgugaccaugcugcucaugcugaugcccaccgcccuggccuuccaccucaccacccggggcggggagccccacaugauggugagcaagcaggagcggggcaagagccugcuguucaagaccagcgccggggugaacaugugcacccucaucgccauggaccugggcgagcugugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccucgcgccccacgugggccuggggcuggagacgcggaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcuguucuccggcgucagcuggaccaugaagaucgggaucggcgugcugcugacguggcucggccugaacucccgcagcaccucccugagcaugaccugcaucgccguggggcucgucacccuguaccugggcgugauggugcaggccgacuccgggugcgucaucaacuggaagggccgggagcucaagugcgggagcggcaucuucgugacgaacgaggugcacaccuggaccgagcaguacaaguuccaggcggacagcccgaagcgccuguccgccgccaucggcaaggccugggaggagggggucugcggcauccggagcgccacccgccuggagaacaucauguggaagcagaucuccaacgagcucaaccacauccugcuggagaacgacaugaaguucaccgugguggucggggacguggcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggaggucgaggacuacggcuucgggaucuucaccacgaacaucuggcugaagcugcgggacagcuacacccaggugugcgaccaccgccucauguccgccgccaucaaggacagcaaggccgugcacgccgacaugggcuacuggaucgaguccgagaagaacgacaccuggaagcuggcgcgggccagcuucaucgaggucaagaccugcaucuggcccaagucccacacgcuguggagcaacggcgugcucgaguccgagaugaucauccccaagaucuacgggggcccgaucagccagcacaacuaccgccccggguacuucacccagaccgccggccccuggcaccuggggaagcuggagcucgacuucgaccugugcgagggcaccacgguggucguggacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgucaaggagaaggaggagaaccuggugaaguccauggugagcgccggcagcggcgaggucgacuccuucagccucgggcugcugugcaucuccaucaugaucgaggaggugaugcggagccgcuggucccggaagaugcucaugaucggcacccuggccguguucuuccugcucaucauggggcagcugaccuggaacgaccugauccgccucugcaucauggucggcgcgaacgccagcgaccgcauggggaugggcacgaccuaccuggcccugauggccaccuucaagaugcggccgauguucgccgugggccuccuguuccgccggcugaccucccgcgaggugcuccugcugacgaucgggcucagccuggucgcguccgccgagcugcccaacagccucgaggagcugggcgacgggcuggccaugggcaucaugauccucaagcugcugaccgacuuccagucccaccagcucugggccacccugcugagccucaccuucaucaagacgaccuucucccugcacuacgcguggaagaccauggccauggugcugagcaucgucucccucuucccccugugccugagcaccacgucccagaagaccaccuggcuccccgugcugcugggcagccucgggugcaagccgcugaccauguuccugaucgccgagaacaagaucuggggccggaaguccuggccccucaacgaggggaucauggccgugggcaucgucagcauccugcugagcucccuccugaagaacgacgugccccuggccgggccccucaucgcgggcggcaugcugaucgccugcuacgugaucagcggguccagcgccgaccugucccucgagaaggccgccgaggucagcugggaggaggaggcggagcacuccggcgccagccacaacauccugguggaggugcaggacgacgggacgaugaagaucaaggacgaggagcgcgacgacacccugaccauccuccugaaggccacccugcucgccgucuccggcguguucccgcugagcauccccgccacccuguucgugugguacuucuggcagaagaagaagcagcgguccgggguccucugggacacgcccagcccgcccgagguggagcgcgcggugcuggacgacggcaucuaccggaucaugcagcgcggccugcuggggcggucccaggucggcguggggguguuccaggagaacgucuuccacaccauguggcacgugacccgcggcgccgugcucauguaccaggggaagcggcuggagcccagcugggccuccgucaagaaggaccugaucagcuacggcggcggguggcgccuccagggcuccuggaacaccggggaggagguccaggugaucgccgucgagcccggcaagaaccccaagaacgugcagacggcccccgggaccuucaagacccccgagggcgaggugggcgcgaucgcccuggacuucaagcccgggaccagcggcucccccaucgucaaccgggaggggaagaucgugggccuguacggcaacgggguggucacgaccagcggcaccuacgugagcgccaucgcccaggcgaaggccucccaggaggggccgcuccccgagaucgaggacgagguguuccgcaagcggaaccugaccaucauggaccugcaccccggcagcgggaagacgcgccgguaccucccggccaucguccgcgaggccaucaagcggaagcugcgcacccugauccucgcccccacccgcgugguggcguccgagauggccgaggcccugaagggcaugcccauccgguaccagaccacggccgucaagagcgagcacaccggcaaggagaucguggaccugaugugccacgccaccuucaccaugcgccuccugucccccgugcgggucccgaacuacaacaugaucaucauggacgaggcgcacuucacggaccccagcuccaucgccgcccgcggguacaucagcacccgggugggcaugggggaggccgccgcgaucuucaugaccgccacgccgcccggcuccguggaggccuucccgcagagcaacgccgucauccaggacgaggagcgcgacauccccgagcgguccuggaacagcggguacgaguggaucacggacuuccccggcaagaccgugugguucgugcccuccaucaagagcggcaacgacaucgcgaacugccugcgcaagaacgggaagcgggucauccagcucucccgcaagaccuucgacaccgaguaccagaagacgaagaacaacgacugggacuacguggugaccaccgacaucagcgagaugggcgccaacuuccgggccgaccgcgucaucgacccgcggcgcugccugaagcccgugauccugaaggacgggcccgagcgggugauccucgccggccccaugccggucaccguggccuccgcggcccagcgccgggggcgcaucggccggaaccacaacaaggagggcgaccaguacaucuacauggggcagccccugaacaacgacgaggaccacgcccacuggacggaggccaagaugcugcucgacaacaucaacacccccgagggcaucauccccgcccuguucgagccggagcgcgagaaguccgcggccaucgacggggaguaccgccugcggggcgaggcccgcaagaccuucgucgagcucaugcggcgcggggaccugcccguguggcuguccuacaagguggccagcgagggcuuccaguacagcgaccggcgcuggugcuucgacggcgagcggaacaaccagguccucgaggagaacauggacguggagaucuggaccaaggagggggagcgcaagaagcugcggccccgcuggcuggacgcccggacguacuccgacccccucgcgcugcgcgaguucaaggaguucgccgccggccggcgcagcguguccggggaccugauccucgagaucggcaagcugccgcagcaccugacccagcgggcccagaacgcgcucgacaaccuggucaugcugcacaacagcgagcagggcgggcgcgccuaccggcacgccauggaggagcuccccgacaccaucgagacccugaugcugcucgcccugaucgccgugcugacgggcggggugacccucuucuuccuguccggccgcgggcugggcaagaccagcaucggccuccugugcgucauggcguccagcgugcugcucuggauggccuccguggagccccacuggaucgccgccagcaucauccuggaguucuuccugaugguccuccugauccccgagccggaccggcagcgcacgccccaggacaaccagcuggccuacguggugaucgggcuccuguucaugauccugaccgucgcggccaacgagaugggccuccuggagacgaccaagaaggaccuggggaucggccacguggccguggagaaccaccaccacgccgccaugcucgacgucgaccugcaccccgcguccgccuggacccuguacgccguggccaccacgaucaucaccccgaugaugcggcacaccaucgagaacaccacggccaacaucagccucaccgcgaucgccaaccaggccgccauccugauggggcuggacaagggcuggcccaucuccaagauggacaucggcgugccccuccuggcgcuggggugcuacagccaggucaacccccucacccugaccgccgccgugcugaugcucguggcccacuacgccaucaucggcccggggcugcaggcgaaggccacgcgcgaggcccagaagcgcaccgccgccggcaucaugaagaaccccaccgucgacgggaucguggcgaucgaccuggaccccguggucuacgacgccaaguucgagaagcagcucggccagaucaugcugcugauccucugcaccucccagauccugcugaugcggacgaccugggcccucugcgagagcaucacccuggccaccggcccccugacgacccucugggagggguccccgggcaaguucuggaacaccaccaucgccgugagcauggcgaacaucuuccgcggguccuaccuggccggcgccggccuggccuucagccucaugaagucccucgggggcgggcggcgcgggacgggggcgcagggcgagacccugggcgagaaguggaagcggcgccucaaccagcuguccaagagcgaguucaacaccuacaagcgguccgggaucauggagguggaccgcagcgaggccaaggagggccugaagcgcggggagaccacgaagcacgccgucucccgcggcaccgccaagcuccggugguucguggagcgcaaccuggugaagcccgaggggaaggucaucgaccugggcugcggccgcgggggcuggagcuacuacugcgccgggcugaagaaggugaccgaggugaagggcuacaccaagggcggccccggccacgaggagcccaucccgauggcgacguacggguggaaccucgucaagcugcacuccggcaaggacguguucuucaucccgcccgagaagugcgacacccugcucugcgacaucggggagagcucccccaacccgaccaucgaggagggccgcacccugcgggugcugaagauggucgagcccuggcuccgcgggaaccaguucugcaucaagauccugaaccccuacaugcccagcgugguggagacgcuggagcagaugcagcggaagcacggcggcaugcucguccgcaacccgcugucccggaacagcacccacgagauguacuggguguccugcgggaccggcaacaucgugagcgccgucaacaugaccucccgcaugcugcucaaccgcuucaccauggcccaccggaagcccacguacgagcgcgacguggaccugggggccggcacccggcacguggccgucgagcccgagguggcgaaccuggacaucaucggccagcgcaucgagaacaucaagcacgagcacaagagcaccuggcacuacgacgaggacaaccccuacaagaccugggccuaccacggguccuacgaggugaagccgagcggcuccgccagcagcauggucaacgggguggucaagcuccugacgaagcccugggacgugauccccauggugacccagaucgccaugaccgacaccacgcccuucggccagcagcgggucuucaaggagaagguggacacccgcaccccgaaggccaagcgggggaccgcgcagaucauggaggugacggcccgcuggcuguggggcuuccucucccggaacaagaagccccgcaucugcacccgggaggaguucacccgcaagguccggagcaacgccgccaucggcgcgguguucaucgacgagaaccaguggaacuccgccaaggaggccguggaggacgagcgcuucugggaccugguccaccgggagcgcgagcugcacaagcaggggaagugcgcgaccugcguguacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccgggguggagggcgaggggcugcacaagcucggcuacauccugcgggacaucagcaagauccccgggggcaacauguacgccgacgacacggccggcugggacacccgcaucaccgaggacgaccugcagaacgaggcgaagaucaccgacaucauggagccggagcacgcccuccuggccaaggccaucuucaagcugacguaccagaacaaggucgugcgcgugcagcggcccgccaagaacgggaccgucauggacgugaucucccgccgggaccagcgcggcagcggccagguggggaccuacggccucaacaccuucacgaacauggaggcgcagcugauccggcagauggaguccgaggggaucuucagccccuccgagcuggagacccccaaccucgccgagcgcguccuggacuggcugggcaaguacgggguggagcggcucaagcgcauggccaucagcggcgacgacugcguggucaagccgaucgacgaccgguucgccaccgcccugaccgcgcugaacgacauggggaaggugcgcaaggacaucccccagugggagcccuccaagggcuggaacgacuggcagcagguccccuucugcagccaccacuuccaccagcucaucaugaaggacggccgggagaucgucgugccgugccgcaaccaggacgagcugguggggcgggcccgcgucucccagggcgccggguggagccugcgggagacggccugccucggcaagagcuacgcgcagauguggcagcugauguacuuccaccgccgggaccugcgccucgccgccaacgccaucugcuccgccgugcccguggacuggguccccaccagccggaccaccugguccauccacgcgcaccaccaguggaugacgaccgaggacaugcugagcguguggaaccgcguguggaucgaggagaaccccuggauggaggacaagacccacaucuccaacugggaggacgucccguaccuggggaagcgcgaggaccaguggugcggcagccucaucggccugaccgcccgggccacgugggccaccaacauccagguggccaucaaccaggugcgccggcugaucgggaacgagaacuaccucgacuacaugaccuccaugaagcgcuucaagaacgagagcgaccccgagggcgcgcugugguga

SEQ ID NO: 7945 - RNA, 9879 nt, Artificial Sequence
  derived and/or modified CDS sequence (opt1) from DENV-1__JN903578__SS-prME
agcgugaccaugcugcucaugcugcugcccaccgcccucgccuuccaccugaccacccgcggcggggagccccacaugaucgugagcaagcaggagcggggcaagagccugcuguucaagaccuccgugggggugaacaugugcacccugaucgcgauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagcggguggagaccugggcccugcgccaccccggguucacggugaucgcccuguuccucgcccacgcgaucggcaccagcaucacccagaaggggaucaucuucauccugcugaugcucgucacccccuccauggccaugcggugcgugggcaucggcaaccgcgacuucguggaggggcugagcggcgccacgugggucgacguggugcuggagcacggguccugcgucaccaccauggccaagaacaagcccacccucgacaucgagcugcugaagacggaggugaccaaccccgccgugcuccggaagcugugcaucgaggcgaagaucagcaacaccaccacggacucccgcugcccgacccagggcgaggccacccuggucgaggagcaggacgccaacuucgugugccggcgcaccuucguggaccggggcugggggaacggcugcggccucuucggcaaggggagccugcugacgugcgccaaguucaagugcgucaccaagcucgagggcaagguggugcaguacgagaaccugaaguacuccgucaucgugaccguccacaccggcgaccagcaccagguggggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcugguccacaagcagugguuccucgaccugccccugcccuggaccuccggggccagcaccagccaggagaccuggaaccggcaggaccuccuggugacguucaagaccgcccacgccaagaagcaggagguggucgugcugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggaggucgccgagacccagcacggcacggugcuggugcaggucaaguacgagggcaccgacgcgcccugcaagauccccuuccucauccaggacgagaagggggugacccagaacggccggcugaucaccgccaacccgaucgugacggacaaggagaagcccgucaacaucgagaccgagccgcccuucggggaguccuacaucguggugggcgccggcgagaaggcccugaagcucagccgcuucaagaagggguccagcaucggcaagauguucgaggcgaccgcccgcggggcccgccgcauggccauccugggcgacaccgccugggacuucggguccaucggcggcgucuucacgagcguggggaagcugauccaccagguguucggcaccgcguacgggguccucuucuccggcgugagcuggaccaugaagaucgggaucggcauccugcugaccuggcucggccugaacucccggagcacgucccugagcaugaccugcaucaccguggggauggucacccucuaccugggcgugauggugcaggccgacuccgggugcgucaucaacuggaagggccgcgagcugaagugcgggagcggcaucuucgugacgaacgaggugcacaccuggaccgagcaguacaaguuccaggccgacuccccgaagcggcucagcgccgccaucggcaaggcgugggaggagggggucugcggcauccgcagcgccacccggcuggagaacaucauguggaagcagaucuccaacgagcugaaccacauccuccuggagaacgacaugaaguucaccgugguggucggggacgccaacggcauccuggcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggagguggaggacuacggcuucgggaucuucaccacgaacaucuggcucaagcugcgcgacagcuacacccagaugugcgaccaccggcugauguccgccgccaucaaggacagcaaggcggugcacgccgacaugggcuacuggaucgaguccgagaagaacgagaccuggaagcucgcccgcgccagcuucaucgagaucaagaccugcaucuggcccaagucccacacgcuguggagcaacggcguccuggaguccgagaugaucauccccaagaucuacgggggcccgaucagccagcacaaccaccggcccggguacuucacccagaccgccggccccuggcaccucgggaagcuggagcuggacuucgacgugugcgagggcaccacgguggucguggacgagcacugcggcaaccgcgggccgucccuccggaccaccaccgugacgggcaagaucauccacgaguggugcugccgcagcugcacccugccgccccugcgguuccgcggggaggacggcugcugguacgggauggagauccggcccgucaaggagaaggaggagaaccucgugcgcuccauggugagcgcgggcuccggcgaggucgacagcuucagccuggggcugcucugcguguccaucaugaucgaggaggugaugcggagccgcuggucccgcaagaugcugaugaccggcacccuggccgucuucuuccuccugaucauggggcagcugacguggaacgaccucauccggcugugcaucauggugggcgccaacgugagcgaccgcauggggaugggcaccaccuaccuggcccucauggccaccuucaagaugcggccgauguucgcggucggccugcuguuccgccggcucacgucccgcgaggugcugcugcucaccaucgggcugagccuggucgccuccgccgagcuccccaacagccuggaggagcugggcgacgggcucgccaugggcaucaugaugcugaagcugcucaccgacuuccagucccaccagcuguggaccacgcugcucagccugaccuucaucaagaccacccugucccucgacuacgccuggaagacgaucaccaugauccugagcaucgugucccuguucccccucugccugagcaccaccucccagaagacgaccuggcugcccgugcuccugggcagcuucgggugcaagccgcugaccauguuccucaucaccgagaacaagaucuggggccggaaguccuggccccugaacgaggggaucauggcggucggcaucgugagcauccugcucuccagccugcugaagaacgacgugccccucgccgggccccugaucgccggcggcaugcugaucgccugcuacgucaucagcggguccagcgcggaccucucccuggagaaggccgccgaggugagcugggaggaggaggccgagcacuccggcaccagccacaacauccugguggagguccaggacgacgggacgaugaagaucaaggacgaggagcgcgacgacacccucaccauccugcugaaggccacccuccuggcgguguccggcguguacccgaugagcauccccgccacgcuguucgucugguacuucuggcagaagaagaagcagcgguccggggugcucugggacacccccagcccgcccgagguggagcgcgccguccuggacgacggcaucuaccggauccugcagcgcggccugcucgggcggucccaggugggcgugggggucuuccaggacggcguguuccacaccauguggcacgugacccgcggggccguccugauguaccagggcaagcggcuggagcccagcugggccuccgugaagaaggaccucaucagcuacggcgggggcuggcgcuuccagggguccuggaacacgggcgaggaggugcaggucaucgcgguggagcccgggaagaaccccaagaacgugcagaccacccccggcaccuucaagacgcccgagggcgaggucggggccaucgcccuggacuucaagcccggcaccagcgggucccccaucgugaaccgggagggcaagaucgugggccuguacgggaacggcgucgugaccaccagcgggacguacguguccgccaucgcccaggcgaaggccagccaggagggcccgcuccccgagaucgaggacgaggucuucaagaagcgcaaccugaccaucauggaccugcaccccgggagcggcaagacccggcgcuaccucccggccaucgugcgggaggccaucaagcgcaagcugcgcacccugauccucgcccccacgcggguggucgcguccgagauggccgaggcccugaagggcaugcccauccgcuaccagaccaccgccgucaagagcgagcacaccgggcgggagaucguggaccugaugugccacgcgacguucaccaugcgccuccugucccccguccgggugccgaacuacaacaugaucaucauggacgaggcccacuucaccgaccccgccagcaucgccgcccgcggcuacaucuccacccggguggggaugggcgaggcggccgccaucuucaugacggccacgccgcccgggagcgucgaggccuucccgcaguccaacgcggugauccaggacgaggagaaggacauccccgagcgcagcuggaacuccggcuacgacuggaucaccgacuuccccggcaagaccgugugguucguccccagcaucaaguccgggaacgacaucgccaacugccugcggaagaacggcaagcgcgugauccagcucagccggaagacguucgacaccgaguaccagaagaccaagaacaacgacugggacuacguggucaccacggacaucuccgagaugggggccaacuuccgcgccgaccgggugaucgacccgcgccggugccugaagcccgugauccugaaggacggccccgagcgcgucauccucgccgggcccaugccggugaccgucgcgagcgccgcccagcggcgcggccggaucggccgcaaccagaacaaggagggggaccaguacguguacaugggccagccccugaacaacgacggggaccacgcccacuggaccgaggcgaagaugcugcucgacaacaucaacacccccgagggcaucauccccgcccuguucgagccggagcgcgagaaguccgccgccaucgacggggaguaccggcugcgcggcgaggcccggaagacguucguggagcucaugcgccggggcgaccugcccgucuggcugagcuacaagguggcguccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcccgcaccuacuccgacccccucgcccugcgggaguucaaggaguucgccgccggccgccggagcgugagcggcgaccugauccucgagaucgggaagcugccgcagcaccugacccuccgcgcgcagaacgcccuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugauggccagcuccgcccuccuguggauggccagcgucgagccccacuggaucgcggccuccaucauccuggaguucuuccucauggugcugcugauccccgagccggaccgccagcggacgccccaggacaaccagcucgccuacguggucaucgggcugcuguucaugauccucaccguggccgccaacgagaugggccugcuggagaccaccaagaaggaccucgggaucggccacguggcggccgagaaccaccaccacgccacgaugcuggacgucgaccugcgccccgccagcgccuggacccucuacgcgguggccaccaccgugaucacgccgaugaugcggcacaccaucgagaacaccaccgccaacaucucccugacggccaucgccaaccaggcggccauccugaugggccucgacaagggguggcccaucagcaagauggacaucggcgucccccugcuggcccucgggugcuacucccaggugaacccccugacccugaccgccgccgugcucaugcuggucgcgcacuacgccaucaucggcccggggcugcaggccaaggccacccgcgaggcgcagaagcgcacggccgccggcaucaugaagaaccccaccguggacggcaucguggccaucgaccucgaccccgucguguacgacgccaaguucgagaagcagcuggggcagaucaugcugcucauccugugcaccagccagauccugcucaugcggaccacgugggcgcugugcgaguccaucacccuggccaccggcccccucaccacgcugugggaggggagcccgggcaaguucuggaacaccaccaucgccguguccauggccaacaucuuccgcggcagcuaccuggccggggcgggccucgccuucucccugaugaagucccucggcgggucccggcgcgggaccggggcccagggcgagacgcucggggagaaguggaagcggcagcugaaccagcugagcaagagcgaguucaacaccuacaagcgcuccggcaucauggaggucgaccggagcgaggccaaggaggggcucaagcgcggcgagaccaccaagcacgccgugucccgggggacggcgaagcugcgcugguucguggagcggaaccuggucaagcccgagggcaaggugaucgaccugggcugcgggcgcggcggguggagcuacuacugcgccggccucaagaaggugaccgaggucaagggguacaccaagggcggccccgggcacgaggagcccaucccgauggccaccuacggcuggaaccuggugaagcugcacuccgggaaggacguguucuucaucccgcccgagaagugcgacacccuccugugcgacaucggcgagagcucccccaacccgacgaucgaggaggggcggacccugcgcguccucaagaugguggagcccuggcugcggggcaaccaguucugcaucaagauccugaaccccuacaugcccagcguggucgagacccucgagcagaugcagcgcaagcacggcgggaugcuggugcggaacccgcugucccgcaacagcacccacgagauguacuggguguccugcggcacggggaacaucgucagcgccgugaacaugaccucccggaugcuccugaaccgcuucaccauggcgcaccgcaagcccaccuacgagcgggacguggaccugggcgccggcacgcgccacgucgccguggagcccgagguggccaaccucgacaucaucgggcagcggaucgagaacaucaagaacgagcacaagagcaccuggcacuacgacgaggacaaccccuacaagaccugggccuaccacggcuccuacgaggucaagccgagcggguccgcgagcuccauggugaacggcgucgugcgccugcugaccaagcccugggacgugauccccauggucacgcagaucgccaugaccgacaccacccccuucgggcagcagcggguguucaaggagaagguggacacgcgcaccccgcgggccaagcgcggcaccgcccagaucauggaggucaccgccaaguggcucuggggcuuccugagccggaacaagaagccccgcaucugcacgcgggaggaguucacccgcaaggugcggagcaacgcggccaucggggccguguucgucgacgagaaccaguggaacuccgccaaggaggccguggaggacgagcgcuucugggaccuggugcaccgggagcgcgagcuccacaagcagggcaagugcgcgaccugcgucuacaacaugauggggaagcgggagaagaagcugggcgaguucgggaaggccaagggcagccgcgccaucugguacauguggcugggcgcccgguuccucgaguucgaggcgcugggguucaugaacgaggaccacugguucucccgcgagaacagccuguccggcguggagggggagggccuccacaagcugggguacauccugcgggacaucagcaagauccccggcggcaacauguacgccgacgacaccgccgggugggacacgcgcaucaccgaggacgaccuccagaacgaggccaagaucaccgacaucauggagccggagcacgcccugcuggcgaccuccaucuucaagcucacguaccagaacaaggugguccgcgugcagcggcccgccaagagcggcaccgugauggacgucaucucccgccgggaccagcgcgggagcggccaggugggcaccuacgggcugaacaccuucacgaacauggaggugcagcugauccggcagauggaguccgagggcaucuuccuccccagcgagcuggagacccccaaccuggccaagcgcguccucgacuggcuggagaagcacggggccgagcggcugaagcgcauggccaucuccggcgacgacugcguggugaagccgaucgacgaccgguucgcgaccgcccucaccgcccugaacgacauggggaagguccgcaaggacaucccccagugggagcccagcaagggcuggaacgacuggcagcagguccccuucugcucccaccacuuccaccagcugaucaugaaggacggccgggagaucguggucccgugccgcaaccaggacgagcucguggggcgggcccgcgugagccagggcgccggguggucccugcgggagacggcgugccugggcaagagcuacgcccagauguggcagcucauguacuuccaccgccgggaccugcgccuggccgccaacgccaucugcagcgcgguccccguggacugggugcccaccucccggaccaccuggagcauccacgcccaccaccaguggaugaccacggaggacaugcucuccgucuggaaccgcguguggaucgaggagaaccccuggauggaggacaagacccacgugagcuccugggaggaggucccguaccuggggaagcgcgaggaccaguggugcggcagccugaucggccucaccgcccgggccaccugggcgacgaacauccagguggccaucaaccaggugcgccggcugaucgggaacgagaacuaccuggacuacaugaccaccaugaagcgcuucaagaacgaguccgaccccgagggcgcccucugguga

SEQ ID NO: 7946 - RNA, 9879 nt, Artificial Sequence
  derived and/or modified CDS sequence (opt1) from DENV-1__JN903579__SS-prME
agcgugaccaugcugcucaugcugcugcccaccgcccucgccuuccaccugaccacccggggcggggagccccacaugaucgugggcaagcaggagcggggcaagagccugcuguucaagaccagcgccggggugaacaugugcacccugaucgccauggaccugggggagcucugcgaggacaccaugaccuacaagugcccccggaucaccgaggccgagcccgacgacguggacugcuggugcaacgccaccgacaccugggugaccuacgggaccugcagccagaccggcgagcaccggcgggacaagcggagcguggcccuggcgccccacguggggcugggccucgagacgcgcaccgagaccuggauguccagcgagggggccuggcggcagauccagaagguggagaccugggcccugcgccaccccggcuucaccgugaucgcccuguuccucgcgcacgccaucgggaccuccaucacccagaagggcaucaucuucauccugcugaugcucgugacccccagcauggccaugcggugcgucggcaucgggaaccgcgacuucguggagggccuguccggggccacguggguggacgucgugcuggagcacggcagcugcgugaccaccauggccaagaacaagcccacccucgacaucgagcugcugaagacggaggucaccaaccccgcggugcuccggaagcugugcaucgaggccaagaucuccaacaccaccacggacagccgcugccccacccagggcgaggccacccugguggaggagcaggacgccaacuucgucugccggcgcaccuucguggaccggggguggggcaacgggugcggccucuucgggaagggcucccugcugacgugcgccaaguucaagugcgugaccaagcucgagggcaagaucguccaguacgagaaccugaaguacagcgugaucgugaccguccacaccggggaccagcaccaggugggcaacgagacgaccgagcacgggaccaucgcgaccaucacgccccaggcccccacguccgagauccagcugaccgacuacggcgcccucacccuggacugcagcccccgcaccgggcuggacuucaacgagaugguccuccugacgaugaaggagaaguccuggcuggugcacaagcagugguuccucgaccugccgcugcccuggaccagcggcgccuccaccagccaggagaccuggaaccggcaggaccuccuggugacguucaagaccgcccacgcgaagaagcaggaggucguggugcugggcagccaggagggggccaugcacaccgcccucaccggcgccacggagauccagaccuccgggaccaccacgaucuucgccggccaccugaagugccgccugaagauggacaagcucacccugaagggggucagcuacgugaugugcaccggcuccuucaagcuggagaaggagguggcggagacccagcacggcacgguccugguccaggugaaguacgaggggaccgacgcccccugcaagauccccuucagcacccaggacgagaagggcgucacccagaacgggcggcucaucacggccaacccgaucgugaccgacaaggagaagcccgugaacaucgagaccgagccgcccuucggcgaguccuacaucgucaucggcgccggggagaaggcgcugaagcugagcugguucaagaagggcuccagcaucgggaagauguucgaggccaccgcccgcggcgcccggcgcauggccauccucggggacacggcgugggacuucggcuccaucggcgggguguucaccagcgugggcaagcugguccaccagguguucgggaccgccuacggcgugcuguucuccggggucagcuggaccaugaagaucggcaucggcauccuccugacguggcuggggcucaacucccgcagcaccucccugagcaugaccugcaucgccgugggcauggugacccuguaccucggggucauggugcaggccgacacgggcugcgugaucaacuggaaggggcgggagcugaagugcggcuccggcaucuucgucaccaacgaggugcacaccuggaccgagcaguacaaguuccaggccgacagcccgaagcgccuguccgcggccaucgggaaggccugggaggagggcgugugcgggauccggagcgccacccgccucgagaacaucauguggaagcagaucagcaacgagcugaaccacauccugcucgagaacgacaugaaguucacggucguggugggcgacgccaacgggauccugacccagggcaagaagaugauccggccccagcccauggagcacaaguacuccuggaaguccuggggcaaggcgaagaucaucggggccgacacccagaacaccacguucaucaucgacggccccgacaccccggagugccccgacgaccagcgcgccuggaacaucugggaggucgaggacuacggguucggcaucuucaccaccaacaucuggcugaagcuccgggacuccuacacgcagaugugcgaccaccgccugaugagcgccgcgaucaaggacuccaaggccgugcacgccgacaugggcuacuggaucgagagcgagaagaacgagaccuggaagcuggcccgggccuccuucaucgaggugaagaccugcaucuggccccgcagccacacccucugguccaacgggguccuggagagcgagaugaucauccccaagaucuacggcgggccgaucucccagcacaacuaccggcccggcuacuucacgcagaccgcggggcccuggcaccugggcaagcucgagcuggacuucaaccugugcgagggcaccaccgugguggucgacgagcacugcgggaaccgcggcccgagccuccggacgaccaccgugaccgggaagaucauccacgaguggugcugccgcuccugcacgcugccgccccugcgguuccgcggcgaggacgggugcugguacggcauggagauccggcccgugaaggagaaggaggagaaccucguccgcagcaugguguccgccggcagcggggagguggacuccuucagccugggccugcucugcgucagcaucaugaucgaggaggugaugcggucccgcuggagccgcaagaugcugaugaccgggacccuggccguguucuuccuccugaucaugggccagcugaccuggaacgaccucauccggcugugcaucauggucggggccaacguguccgaccgcaugggcaugggcacgaccuaccuggcccucauggcgaccuucaagaugcggccgauguucgccguggggcugcuguuccgccggcucaccagccgcgagguccugcugcucacgaucggccugucccugguggccagcgccgagcuccccaacucccuggaggagcugggggacggccucgccaugggcaucaugaugcugaagcugcucaccgacuuccagagccaccagcuguggaccacccugcucucccugacguucaucaagaccacccugagccucgacuacgcguggaagaccaucgccaugauccuguccaucgucagccuguucccccucugccuguccacgaccagccagaagaccaccuggcugcccgugcuccugggguccuucggcugcaagccgcugaccauguuccucaucacggagaacaagaucugggggcgcaagagcuggccccugaacgagggcaucauggccguggggaucgucuccauccugcucagcucccugcugaagaacgacgugccccucgccggcccccugaucgcgggcgggaugcugaucgccugcuacgugaucagcggcagcuccgccgaccucagccuggagcgcgccgccgaggucuccugggaggaggaggcggagcacagcggggccucccacaacauccugguggaggugcaggacgacggcaccaugaagaucaaggacgaggagcgggacgacacccucaccauccugcugaaggccacgcuccuggccgucagcgggguguacccgauguccauccccgccacccuguucgugugguacuucuggcagaagaagaagcagcgcagcggcguccucugggacacccccagcccgcccgagguggagcgggcggugcuggacgacggcaucuaccgcauccugcagcgggggcugcucggccgcagccaggucggggugggcguguuccaggacggggucuuccacaccauguggcacgugacgcggggcgccgugcugauguaccagggcaagcgccuggagcccuccugggccagcgucaagaaggaccucaucuccuacgggggcggguggcgguuccagggcagcuggaacaccggggaggagguccaggugaucgccgucgagcccggcaagaaccccaagaacgugcagaccacccccggcacguucaagacccccgagggggaggugggcgccaucgcgcuggacuucaagcccgggaccuccggcagccccaucgucaaccgcgagggcaagaucguggggcuguacggcaacgggguggucaccacguccggcaccuacgugagcgccaucgcccaggccaaggccucccaggaggggccgcuccccgagaucgaggacgagguguucaagaagcggaaccugaccaucauggaccugcaccccggcagcggcaagacccgccgguaccucccggcgaucguccgcgaggccaucaagcgcaagcugcggacgcugauccucgcccccacccgcgugguggccagcgagauggcggaggcccugaaggggaugcccauccgguaccagaccaccgccgucaaguccgagcacacgggccgcgagaucguggaccugaugugccacgccaccuucaccaugcggcuccugagccccgugcgcgucccgaacuacaacaugaucaucauggacgaggcccacuucaccgaccccgcguccaucgccgcccggggguacaucagcacgcgcgugggcaugggggaggccgccgcgaucuucaugaccgccacgccgcccggcuccguggaggccuucccgcagagcaacgccgucauccaggacgaggagcgggacauccccgagcgcuccuggaacagcggcuacgacuggaucaccgacuuccccgggaagacggugugguucgugcccuccaucaagagcggcaacgacaucgccaacugccugcggaagaacgggaagcgcgucauccagcucucccggaagaccaucgacaccgaguaccagaagaccaagaacaacgacugggacuacguggugacgaccgacaucagcgagaugggcgcgaacuuccgcgccgaccgggucaucgacccgcgccggugccugaagcccgugauccugaaggacgggcccgagcgcgugauccucgccggccccaugccggucaccgccgcguccgccgcccagcggcgcggccgcaucgggcggaaccagaacaaggagggcgaccaguacaucuacauggggcagccccugaacaacgacgaggaccacgcccacuggaccgaggccaagaugcugcucgacaacaucaacacgcccgagggcaucauccccgcgcuguucgagccggagcgcgagaaguccgccgccaucgacggggaguaccggcugcgcggcgaggcccggaagaccuucguggagcucaugcgccggggcgaccugcccgucuggcuguccuacaagguggccagcgagggguuccaguacuccgaccgccgguggugcuucgacggcgagcgcaacaaccaggugcucgaggagaacauggacgucgagaucuggaccaaggagggggagcggaagaagcugcgcccccgguggcuggacgcgcgcaccuacagcgacccccucgcccugcgggaguucaaggaguucgccgccggccgccgguccgugagcggcgaccugauccucgagaucgggaagcugccgcagcaccugacccuccgcgcccagaacgcgcuggacaaccuggugaugcuccacaacagcgagcagggcgggaaggccuaccggcacgccauggaggagcugcccgacacgaucgagacccugaugcuccuggcccugaucgcgguccucaccggcggggugacccuguucuuccuguccggcaagggccucgggaagacgagcaucggccugcugugcgugauggccuccagcguccuccuguggauggccuccguggagccccacuggaucgccgccagcaucauccuggaguucuuccucauggugcugcugauccccgagccggaccgccagcggacgccccaggacaaccagcucgcguacgucgugaucgggucccuguucaugauccugaccguggccgccaacgagaugggccuccuggagaccacgaagaaggaccuggggaucggccacgucguggccgagaaccaccaccacgccaccacccucgacaucgaccugcaccccgcgagcgccuggacccuguacgccguggccacgaccaucaucaccccgaugaugcgccacaccaucgagaacacgaccgccaacaucucccucaccgcgaucgccaaccaggccgccauccugaugggccuggacaagggguggcccaucagcaagauggacaucggcgucccccuccuggcccuggggugcuacucccaggugaacccccucacccugacggcggccgugcugaugcucgucgcccacuacgccaucaucggcccggggcugcaggcgaaggccacccgcgaggcccagaagcggaccgccgccggcaucaugaagaaccccaccguggacggcaucguggcgaucgaccuggaccccgucguguacgacgccaaguucgagaagcagcucgggcagaucaugcugcugauccucugcacgagccagauccugcugaugcgcaccaccugggcccucugcgaguccaucacccuggccacgggcccccugaccacccucugggaggggagcccgggcaaguucuggaacaccacgaucgccguguccauggcgaacaucuuccggggcagcuaccuggccggggccggccuggccuucucccucaugaagucccucgggggcgggcgccggggcaccggcgcccagggggagacccugggcgagaaguggaagcgccagcucaaccagcuguccaagagcgaguucaacaccuacaagcggagcgggaucauggaggucgaccgcuccgaggcgaaggagggccugaagcgcggggagacgaccaagcacgccgugagccgcggcaccgccaagcuccggugguucguggagcgcaaccuggucaagcccgagggcaaggugaucgaccuggggugcggccgcgggggcugguccuacuacugcgccgggcugaagaaggugaccgaggucaagggcuacaccaagggcgggcccggccacgaggagcccaucccgauggcgacguacggguggaacaucgugaagcuccacagcggcaaggacguguucuucacgccgcccgagaagugcgacacccugcugugcgacaucggggaguccagccccaacccgaccaucgaggagggccgcacgcuccggguccugaagaugguggagcccuggcugcgcggcaaccaguucugcaucaagauccucaaccccuacaugcccuccguggucgagacccuggagcagaugcagcggaagcacgggggcaugcuggugcgcaacccgcucagccggaacuccacccacgagauguacugggugagcugcgggaccggcaacaucgucuccgccgugaacaugacgagccgcaugcugcugaaccgcuucaccauggcccaccggaagcccaccuacgagcgcgacguggaccucggcgccgggacccggcacgucgccguggagcccgagaucgcgaaccuggacaucaucggccagcgcaucgagaacaucaagaacgagcacaaguccacguggcacuacgacgaggacaaccccuacaagaccugggccuaccacgggagcuacgaggugaagccguccggcagcgccuccagcauggucaacgggguggugcggcugcucaccaagcccugggacgucauccccauggugacccagaucgccaugacggacaccacccccuucggccagcagcgcgucuucaaggagaagguggacacccggacgccgcgccccaagcggggcaccgcccagaucauggaggugaccgcgaaguggcuguggggguuccugucccgcaacaagaagccccggaucugcacccgcgaggaguucacgcggaagguccgcagcaacgccgccaucggcgccguguucguggacgagaaccaguggaacagcgccaaggaggcggucgaggacgagcgguucugggaccucgugcaccgcgagcgggagcugcacaagcaggggaagugcgcgaccugcguguacaacaugaugggcaagcgcgagaagaagcugggggaguucggcaaggccaagggcucccgggccaucugguacauguggcucggggcgcgcuuccuggaguucgaggcccugggcuucaugaacgaggaccacugguucagccgggagaacucccucagcggggucgagggcgaggggcuguacaagcugggcuacauccuccgcgacaucuccaagaucccgggcgggaacauguacgccgacgacaccgccggcugggacacccgcaucacggaggacgaccugcagaacgaggccaagaucaccgacaucauggagcccgagcacgcgcugcucgccaccagcaucuucaagcugaccuaccagaacaagguggugcggguccagcgccccgccaaguccgggacggugauggacgugaucagccggcgcgaccagcggggcuccggccaggucgggaccuacggccugaacaccuucaccaacauggaggugcagcucauccgccagauggagagcgaggggaucuucucccccagcgagcuggagaacuccaaccuggccgagcgggugcucgacuggcuggagaagcacggcgucgagcgccugaagcggauggccaucagcggggacgacugcguggugaagccgacggacgaccgcuucgcgaccgcccucaccgcccugaacgacaugggcaagguccggaaggacaucccccagugggagcccuccaagggcuggaacgacuggcagcagguccccuucugcagccaccacuuccaccagcugaucaugaaggacgggcgcgagaucguggucccgugccggaaccaggacgagcucgugggccgcgcccgggugucccagggggccggcuggagccugcgcgagaccgcgugccugggcaagagcuacgcccagauguggcagcucauguacuuccaccggcgcgaccugcggcuggccgccaacgccaucugcuccgcgguccccgugaacugggugcccaccagccgcacgaccugguccauccacgcccaccaccaguggaugaccaccgaggacaugcucagcgucuggaaccgcguguggaucgaggagaaccccuggauggaggacaagacgcacguguccagcugggaggacgucccguaccugggcaagcgggaggaccaguggugcggcucccugaucgggcucaccgcccgcgccaccugggcgaccaacauccagguggccaucaaccaggugcggcgccugaucggcaacgagaacuacagcgacuacacgaccuccaugaagcgguucaagaacgagagcgaccccgagggggcccugugguga

SEQ ID NO: 7947 - RNA, 9879 nt, Artificial Sequence
  derived and/or modified CDS sequence (opt1) from DENV-1__JN903580__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccuucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcaacaccucccugagcaugaccugcaucgccguggggauggugacccuguaccucggcgucauggugcaggccgacacggggugcgugaucaacuggaagggccgggagcugaagugcggguccggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucagcaacgagcugaaccacauccugcucgagaacgacaugaaguucacggucguggugggggacgccaacggcauccugacccaggggaagaagaugauccggccccagcccauggagcacaaguacuccuggaaguccuggggcaaggcgaagaucaucggcgccgacacccagaacaccacguucaucaucgacgggcccgacaccccggagugccccgacgaccagcgcgccuggaacaucugggaggucgaggacuacggcuucgggaucuucaccaccaacaucuggcugaagcuccgggacuccuacacgcagaugugcgaccaccgccugaugagcgccgcgaucaaggacuccaaggccgugcacgccgacaugggcuacuggaucgagagcgagaagaacgagaccuggaagcuggcccgggccuccuucaucgaggugaagaccugcaucuggccccgcagccacacccucugguccaacggcguccuggagagcgagaugaucauccccaagaucuacgggggcccgaucucccagcacaacuaccggcccggguacuucacgcagaccgcgggccccuggcaccuggggaagcucgagcuggacuucaaccugugcgagggcaccaccgugguggucgacgagcacugcggcaaccgcgggccgagccuccggacgaccaccgugaccggcaagaucauccacgaguggugcugccgcuccugcacgcugccgccccugcgguuccgcggggaggacggcugcugguacgggauggagauccggcccgugaaggagaaggaggagaaccucguccgcagcaugguguccgccggcagcggcgagguggacuccuucagccuggggcugcucugcgucagcaucaugaucgaggaggugaugaagucccgguggagccgcaagaugcugaugaccggcacccuggccguguucuuccuccugaucauggggcagcugaccuggaacgaccucauccgccugugcaucauggucggcgccaacguguccgaccggauggggaugggcacgaccuaccuggcccucauggcgaccuucaagaugcgcccgauguucgccguggggcugcuguuccggcgccucaccagccgggagguccugcugcucacgaucgggcugucccugguggccagcgccgagcuccccaacucccuggaggagcugggcgacgggcucgccaugggcaucaugaugcugaagcugcucaccgacuuccagagccaccagcuguggaccacccugcucucccugacguucaucaagaccacccugagccucgacuacgcguggaagaccaucgccaugauccuguccaucgucagccuguucccccucugccuguccacgaccagccagaagaccaccuggcugcccgugcuccugggcuccuucgggugcaagccgcugaccauguuccucaucacggagaacaagaucuggggccgcaagagcuggccccugaacgaggggaucauggccgugggcaucgucuccauccugcucagcucccugcugaagaacgacgugccccucgccgggccccugaucgcgggcggcaugcugaucgccugcuacgugaucagcgggagcuccgccgaccucagccuggagcgggccgccgaggucuccugggaggaggaggcggagcacagcggcgccucccacaacauccugguggaggugcaggacgacgggaccaugaagaucaaggacgaggagcgcgacgacacccucaccauccugcugaaggccacgcuccuggccaucagcggcgucuacccgauguccauccccgccacccuguucgugugguacuucuggcagaagaagaagcagcggagcggggugcucugggacacccccagcccgcccgaggucgagcgcgcggugcuggacgacggcaucuaccggauccugcagcgcggccugcucgggcggagccaggugggcgucgggguguuccaggacggcguguuccgcaccauguggcacgucacgcgcggggccgugcugauguaccagggcaagcgccuggagcccuccugggccagcgugaagaaggaccucaucuccuacggcgggggcuggcgguuccaggggagcuggaacaccggcgaggagguccaggugaucgccguggagcccgggaagaaccccaagaacguccagaccacccccggcacguucaagacccccgagggcgaggugggggccaucgcgcuggacuucaagcccggcaccuccgggagccccaucgugaaccgcgagggcaagaucgucggccuguacgggaacggcguggugaccacguccgggaccuacgucagcgccaucgcccaggccaaggccucccaggagggcccgcuccccgagaucgaggacgagguguucaagaagcggaaccugaccaucauggaccugcaccccgggagcggcaagacccgccgguaccucccggcgaucgugcgcgaggccaucaagcgcaagcugcggacgcugauccucgcccccacccgcgucguggccagcgagauggcggaggcccugaagggcaugcccauccgguaccagaccaccgccgugaaguccgagcacacggggcgcgagaucgucgaccugaugugccacgccaccuucaccaugcggcuccugagccccgugcgcgugccgaacuacaacaugaucaucauggacgaggcccacuucaccgaccccgcguccaucgccgcccggggcuacaucagcacgcgcgucgggaugggcgaggccgccgcgaucuucaugaccgccacgccgcccggguccguggaggccuucccgcagagcaacgccgugauccaggacgaggagcgggacauccccgagcgcuccuggaacagcggcuacgacuggaucaccgacuuccccggcaagacggucugguucgugcccuccaucaagagcgggaacgacaucgccaacugccugcggaagaacggcaagcgcgugauccagcucucccggaagaccuucgacaccgaguaccagaagaccaagaacaacgacugggacuacgucgugacgaccgacaucagcgagaugggggcgaacuuccgcgccgaccgggugaucgacccgcgccggugccugaagcccgucauccugaaggacggccccgagcgcgugauccucgccgggcccaugccggugaccgccgcguccgccgcccagcggcgcggccgcaucggccggaaccagaacaaggagggggaccaguacaucuacaugggccagccccugaacaacgacgaggaccacgcccacuggaccgaggccaagaugcugcucgacaacaucaacacgcccgaggggaucauccccgcgcuguucgagccggagcgcgagaaguccgccgccaucgacggcgaguaccggcugcgcggggaggcccggaagaccuucgucgagcucaugcgccggggcgaccugcccguguggcuguccuacaaggucgccagcgagggcuuccaguacuccgaccgccgguggugcuucgacggggagcgcaacaaccaggugcucgaggagaacauggacguggagaucuggaccaaggagggcgagcggaagaagcugcgcccccgguggcuggacgcgcgcaccuacagcgacccccucgcccugcgggaguucaaggaguucgccgccgggcgccgguccgucagcggcgaccugauccucgagaucggcaagcugccgcagcaccugacccuccgcgcccagaacgcgcuggacaaccuggugaugcuccacaacagcgagcagggcgggaaggccuaccggcacgccauggaggagcugcccgacacgaucgagacccugaugcuccuggcccugaucgcggugcucaccgggggcgucacccuguucuuccuguccgggaagggccucggcaagacgagcaucgggcugcugugcgugauggccuccagcgugcuccuguggauggccuccgucgagccccacuggaucgccgccagcaucauccuggaguucuuccucauggugcugcugauccccgagccggaccgccagcggacgccccaggacaaccagcucgcguacguggucaucggccugcuguucaugauccucaccguggccgccaacgagauggggcugcuggagaccacgaagaaggaccucggcaucgggcacguggucgccgagaaccaccaccacgccaccaugcuggacaucgaccugcaccccgcguccgccuggacccucuacgccguggccaccacgaucaucaccccgaugaugcgccacaccaucgagaacaccacggccaacaucagccugaccgcgaucgccaaccaggccgccauccugaugggccucgacaagggcuggcccaucuccaagauggacaucggggugccccugcuggcccucggcugcuacagccaggucaacccccugacccugaccgcggccgugcucaugcugguggcccacuacgccaucaucgggccgggccugcaggcgaaggccacgcgcgaggcccagaagcggaccgccgccgggaucaugaagaaccccaccgucgacggcaucguggcgaucgaccucgaccccguggucuacgacgccaaguucgagaagcagcugggccagaucaugcugcucauccugugcaccucccagauccugcucaugcgcacgaccugggcccugugcgagagcaucacccuggccaccgggccccucacgacccugugggagggcuccccggggaaguucuggaacaccaccaucgccgugagcauggcgaacaucuuccggggcuccuaccuggccggcgccgggcucgccuucagccugaugaagucccugggcgggggccgccgggacacgggggcccagggcgagacccucggcgagaaguggaagcgccagcugaaccagcugagcaagcccgaguucaacaccuacaagcgguccgggaucauggagguggaccgcagcgaggcgaaggagggccucaagcgcggggagaccacgaagcacgccgucagccgcggcaccgccaagcugcggugguucguggagcgcaaccuggugaagcccgaggggaaggucaucgaccugggcugcggccgcggcgggugguccuacuacugcgccgggcucaagaaggugaccgaggugaagggguacaccaagggcgggcccggccacgaggagccgauccccauggcgaccuacggguggaacaucgucaagcugcacagcggcaaggacguguucuucacgccgcccgagaagugcgacacccugcucugcgacaucggggaguccagcccgaaccccaccaucgaggagggccgcacccugcgggugcugaagauggucgagcccuggcuccgcgggaaccaguucugcaucaagauccugaaccccuacaugccguccgugguggagacgcuggagcagaugcagcggaagcacggcggcaugcucguccgcaacccccugagccggaacuccacccacgagauguacugggugagcugcgggaccggcaacaucguguccgccgucaacaugaccagccgcaugcugcucaaccgcuucacgauggcccaccggaagcccaccuacgagcgcgacguggaccugggggccggcacccggcacguggccgucgagcccgagaucgcgaaccuggacaucaucggccagcgcauggagaacaucaagaacgagcacaaguccaccuggcacuacgacgaggacaacccguacaagacgugggccuaccacgggagcuacgaggugaagcccuccggcagcgccuccagcauggugaacggggucgugcggcuccugaccaagcccugggacgugauccccauggucacccagaucgccaugaccgacacgaccccguucggccagcagcgcguguucaaggagaaggucgacacccggacgccccggcccaagcgggggacggcccagaucauggaggugaccgcgaaguggcuguggggcuuccucucccgcaacaagaagccgcggaucugcacccgcgaggaguucacccggaaggugcgcagcaacgccgccaucggcgccgucuucguggacgagaaccaguggaacuccgccaaggaggcgguggaggacgagcgguucugggaccugguccaccgcgagcgggagcugcacaagcaggggaagugcgccacgugcguguacaacaugaugggcaagcgcgagaagaagcucggggaguucggcaaggccaaggggagccgggccaucugguacauguggcugggcgcgcgcuuccuggaguucgaggcccucggcuucaugaacgaggaccacugguucagccgggagaacucccugagcgggguggagggcgaggggcuguacaagcucggcuacauccugcgcgacaucuccaagauccccgggggcaacauguacgccgacgacaccgccggcugggacacccgcaucaccgaggacgaccugcagaacgaggccaagaucacggacaucauggagcccgagcacgcgcuccuggccaccagcaucuucaagcugaccuaccagaacaaggucgugcgggugcagcgccccgccaaguccgggaccgucauggacgugaucagccggcgcgaccagcggggcuccggccaggugggcacguacggccucaacaccuucaccaacauggagguccagcugauccgccagauggagagcgaggggaucuucuccccgagcgagcuggagaacuccaaccucgccgagcgggugcuggacuggcuggagaagcacggcguggagcgccucaagcggauggccaucagcggggacgacugcgucgugaagcccaccgacgaccgcuucgcgacggcccugaccgcccugaacgacaugggcaaggugcggaaggacaucccccagugggagcccuccaagggguggaacgacuggcagcaggucccguucugcagccaccacuuccaccagcucaucaugaaggacggccgcgagaucguggugcccugccggaaccaggacgagcuggucggccgcgcccgggugucccagggggccggcuggagccugcgcgagaccgcgugccucgggaaguccuacgcccagauguggcagcugauguacuuccaccggcgcgaccugcggcucgccgccaacgccaucugcagcgcggugcccgucaacugggugcccaccagccgcaccacgugguccauccacgcccaccaccaguggaugaccaccgaggacaugcugagcguguggaaccgcgucuggaucgaggagaacccguggauggaggacaagacccacguguccagcugggaggacgugcccuaccugggcaagcgggaggaccaguggugcgggucccucaucggccugacggcccgcgccaccugggcgaccaacauccaggucgccaucaaccaggugcggcgccugaucggcaacgagaacuacagcgacuacaugaccuccaugaagcgguucaagaacgagagcgaccccgagggggcccucugguga

SEQ ID NO: 7948 - RNA, 9879 nt, Artificial Sequence
  derived and/or modified CDS sequence (opt1) from DENV-1__JN903581__SS-prME
agcgugaccaugcugcucaugcugcugcccaccgcccucgccuuccaccugaccacccgcggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccuucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcaacaccucccugagcaugaccugcaucgccguggggauggugacccuguaccucggcgucauggugcaggccgacacggggugcgugaucaacuggaagggccgggagcugaagugcggguccggcaucuucgucaccaacgaggugcacaccuggaccgagcaguacaaguuccaggccgacagcccgaagcgccuguccgcggccaucggcaaggccugggaggagggggugugcggcauccggagcgccacccgccucgagaacaucauguggaagcagaucagcaacgagcugaaccacauccugcucgagaacgacaugaaguucacggucguggugggggacgccaacggcauccugacccaggggaagaagaugauccggccccagcccauggagcacaaguacuccuggaaguccuggggcaaggcgaagaucaucggcgccgacacccagaacaccacguucaucaucgacgggcccgacaccccggagugccccgacgaccagcgcgccuggaacaucugggaggucgaggacuacggcuucgggaucuucaccaccaacaucuggcugaagcuccgggacuccuacacgcagaugugcgaccaccgccugaugagcgccgugaucaaggacuccaaggcggugcacgccgacaugggcuacuggaucgagagcgagaagaacgagaccuggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacgcagaccgccggccccuggcaccuggggaagcucgagcuggacuucaaccugugcgagggcaccaccguggucguggacgagcacugcggcaaccgcgggccgagccuccggacgaccaccgugaccggcaagaucauccacgaguggugcugccgcuccugcacgcugccgccccugcgguuccgcggggaggacggcugcugguacgggauggagauccggcccgucaaggaggaggaggagaaccucgugcgcagcaugguguccgcgggcagcggcgaggucgacuccuucagccuggggcugcucugcgugagcaucaugaucgaggaggugaugaagucccgguggagccgcaagaugcugaugaccggcacccuggccgucuucuuccuccugaucauggggcagcugaccuggaacgaccucauccgccugugcaucauggugggcgccaacguguccgaccggauggggaugggcacgaccuaccuggcccucauggccaccuucaagaugcgcccgauguucgcggucgggcugcuguuccggcgccucaccagccgggaggugcugcugcucacgaucgggcugucccuggucgccagcgccgagcuccccaacucccuggaggagcugggcgacgggcucgccaugggcaucaugaugcugaagcugcucgccgacuuccagagccaccagcuguggaccacccugcucucccugaccuucaucaagacgacccugagccucgacuacgcguggaagaccaucgccaugauccuguccaucgugagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgucggcaucguguccauccugcucagcucccugcugaagaacgacgugccccucgccgggccccugaucgcgggcggcaugcugaucgccugcuacgucaucagcgggagcuccgccgaccucagccuggagcgggccgccgagguguccugggaggaggaggcggagcacagcggcgccucccacaacauccugguggagguccaggacgacgggacgaugaagaucaaggacgaggagcgcgacgacacccucaccauccugcugaaggccacccuccuggccaucagcggcguguacccgauguccauccccgccacgcuguucgugugguacuucuggcagaagaagaagcagcggagcgggguccucugggacacccccagcccgcccgagguggagcgcgcggugcuggacgacggcaucuaccggauccugcagcgcggccugcucgggcggagccaggucggcguggggguguuccaggacggcgucuuccacaccauguggcacgugacccgcggggccgugcugauguaccagggcaagcggcuggagcccuccugggccagcgucaagaaggaccucaucuccuacggcgggggcuggcgcuuccaggggagcuggaacacgggcgaggagguccaggugaucgccgucgagcccgggaagaaccccaagaacgugcagaccacccccggcaccuucaagacgcccgagggcgaggugggggccaucgcgcuggacuucaagcccggcaccuccgggagccccaucgucaaccgggagggcaagaucgugggccuguacggggacggcguggucaccaccuccgggacguacgugagcgccaucgcccaggccaaggccucccaggagggcccgcuccccgagaucgaggacgagguguucaagaagcgcaaccugaccaucauggaccugcaccccgggagcggcaagacccggcgcuaccucccggcgaucguccgggaggccaucaagcgcaagcugcgcacccugauccucgcccccacgcgggugguggccagcgagauggcggaggcccugaagggcaugcccauccgcuaccagaccaccgccgucaaguccgagcacaccgggcgggagaucguggaccugaugugccacgccacguucaccaugcgccuccugagccccgugcgggucccgaacuacaacaugaucaucauggacgaggcccacuucaccgaccccgcguccaucgccgcccgcggcuacaucagcacccggguggggaugggcgaggccgccgcgaucuucaugacggccacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggcgaacuuccgggccgaccgcgucaucgacccgcggcgcugccuggagcccgugauccugaaggacggccccgagcgggugauccucgccgggcccaugccggucaccgccgcguccgccgcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcgcuguucgagccggagcgggagaaguccgccgccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcgcggaccuacagcgacccccucgcccugcgcgaguucaaggaguucgccgccgggcggcgcuccgugagcggcgaccugauccucgagaucggcaagcugccgcagcaccugacccuccgggcccagaacgcgcuggacaaccuggugaugcuccacaacagcgagcagggcgggaaggccuaccgccacgccauggaggagcugcccgacaccaucgagacgcugaugcuccuggcccugaucgcgguccucaccgggggcgugacccuguucuuccuguccgggaagggccucggcaagaccagcaucgggcugcugugcgugauggccuccagcguccuccuguggauggccuccguggagccccacuggaucgccgccagcaucauccuggaguucuuccucauggugcugcugauccccgagccggaccggcagcgcacgccccaggacaaccagcucgcguacgucgugaucggccugcuguucaugauccucaccguggccgccaacgagauggggcugcuggagaccaccaagcgggaccucggcaucgggcacgucguggccgagaaccaccaccacgccacgaugcuggacaucgaccugcaccccgcguccgccuggacccucuacgccguggccaccaccaucaucacgccgaugaugcgccacaccaucgagaacaccaccgccaacaucagccugacggcgaucgccaaccaggccgccauccugaugggccucgacaagggcuggcccaucuccaagauggacaucggggucccccugcuggcccucggcugcuacagccaggugaacccccugacccugaccgcggccgugcucaugcuggucgcccacuacgccaucaucgggccgggccugcaggcgaaggccacccgcgaggcccagaagcggacggccgccgggaucaugaagaaccccaccguggacggcaucguggcgaucgaccucgaccccgucguguacgacgccaaguucgagaagcagcugggccagaucaugcugcucauccugugcaccucccagauccugcucaugcgcaccacgugggcccugugcgagagcaucacccuggccaccgggccccucaccacgcugugggagggcuccccggggaaguucuggaacaccaccaucgccgugagcauggcgaacaucuuccggggcuccuaccuggccggcgccgggcucgccuucagccugaugaagucccugggcgggggccgccgggggaccggcgcccagggcgagacgcucggggagaaguggaagcgccagcugaaccagcugagcaaguccgaguucaacaccuacaagcggagcggcaucauggaggucgaccgcagcgaggcgaaggaggggcucaagcggggcgagaccaccaagcacgccgugucccgcgggacggugaagcugcggugguucgucgagcgcaaccuggugaagcccgagggcaaggugaucgaccugggcugcgggcggggcggguggagcuacuacugcgccggccucaagaaggucaccgaggugaagggguacaccaagggcggccccgggcacgaggagcccaucccgauggccaccuacggcuggaacaucgugaagcugcacuccgggaaggacgucuucuucacgccgcccgagaagugcgacacgcugcucugcgacaucggcgagagcucccccaacccgaccaucgaggaggggcgcacccugcgggugcugaagaugguggagcccuggcuccgcggcaaccaguucugcaucaagauccugaaccccuacaugcccagcgucguggagacccuggagcagaugcagcggaagcacggcgggaugcucgugcgcaacccgcugucccggaacagcacgcacgagauguacugggucuccugcggcaccgggaacaucgugagcgcggugaacaugaccucccgcaugcugcucaaccgcuucaccauggcccaccggaagcccacguacgagcgcgacgucgaccugggcgccggcacccggcacguggccguggagcccgagaucgccaaccuggacaucaucgggcagcgcaucgagaacaucaagaacgagcacaagagcaccuggcacuacgacgaggacaaccccuacaagaccugggcguaccacggcuccuacgaggucaagccgagcggguccgccagcuccauggugaacggcgugguccggcuccugacgaagcccugggacgugauccccauggucacccagaucgccaugaccgacaccacgcccuucgggcagcagcgcguguucaaggagaagguggacacccggaccccgcgccccaagcggggcaccgcccagaucauggaggucacggccaaguggcuguggggcuuccucagccgcaacaagaagccccggaucugcacccgcgaggaguucacccggaaggugcgcuccaacgcggccaucggggccguguucgucgacgagaaccaguggaacagcgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccuguacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggugguccgggugcagcgccccgccaagagcggcaccgugauggacgucaucucccggcgcgaccagcgggggagcggccaggugggcaccuacgggcucaacacguucaccaacauggaggugcagcugauccgccagauggaguccgagggcaucuucagccccuccgagcuggagaacagcaaccucgccgagcggguccuggacuggcuggagaagcacgggguggagcgccucaagcggauggccaucuccggcgacgacugcguggucaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucgucgugccgugccggaaccaggacgagcugguggggcgcgcccgggucagccagggcgccggguggucccugcgcgagaccgccugccucggcaagagcuacgcgcagauguggcagcugauguacuuccaccggcgcgaccugcggcucgccgccaacgccaucugcagcgccgugcccgugaacuggguccccaccucccgcaccaccuggagcauccacgcgcaccaccaguggaugacgaccgaggacaugcuguccguguggaaccgcguguggaucgaggagaaccccuggauggaggacaagacccacgucagcuccugggaggacgugccguaccuggggaagcgggaggaccaguggugcggcagccucaucggccugaccgcccgcgccacgugggccaccaacauccagguggcgaucaaccagguccggcgccugaucgggaacgagaacuacuccgacuacaugaccagcaugaagcgguucaagaacgaguccgaccccgagggcgcccucugguga

SEQ ID NO: 7949 - RNA, 9879 nt, Artificial Sequence
  derived and/or modified CDS sequence (opt1) from DENV-1__KX380796__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggcggcagaugcagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaccguccaguacgagaaccugaaguacuccgugaucgugaccguccacacgggcgaccagcaccagguggggaacgagaccaccgagcacggcaccaucgcgaccaucacgccccaggcccccaccagcgagauccagcugaccgacuacggggcccucacccuggacugcagcccccggacgggccuggacuucaacgagaugguccuccugaccaugaaggagaaguccuggcuggugcacaagcagugguuccucgaccugccgcugcccuggaccuccggggccagcaccagccaggagacguggaaccggcaggaccuccuggugaccuucaagaccgcccacgcgaagaagcaggaggucguggugcugggcucccaggagggcgccaugcacaccgcccucacgggggccaccgagauccagaccagcggcaccacgaccaucuucgccgggcaccugaagugccgccugaagauggacaagcucacccugaagggcgucuccuacgugaugugcaccgggagcuucaagcuggagaaggagguggcggagacgcagcacggcaccguccugguccaggugaaguacgagggcaccgacgcccccugcaagauccccuucuccacccaggacgagaagggggucacgcagaacggccggcucaucaccgccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcguguucaccuccguggggaagcugguccaccagguguucggcaccgccuacggggugcuguucaacggcgucagcuggacgaugaagaucgggaucggcauccuccugaccuggcugggccucaacucccgcagcaccucccugagcaugaccugcaucgccguggggauggugacgcuguaccucggcgucauggugcaggccgacuccgggugcgugaucaacuggaagggccgggagcugaagugcgggagcggcaucuucgucaccaacgaggugcacaccuggaccgagcaguacaaguuccaggccgacuccccgaagcgccugagcgcggccaucggcaaggccugggaggagggggugugcggcauccggagcgccacccgccucgagaacaucauguggaagcagaucuccaacgagcugaaccacauccugcucgagaacgacaugaaguucacggucguggugggggacgccaacggcauccugacccaggggaagaagaugauccggccccagcccauggagcacaaguacagcuggaaguccuggggcaaggcgaagaucaucggcgccgacacccagaacaccacguucaucaucgacgggcccgacaccccggagugccccgacgaccagcgcgccuggaacaucugggaggucgaggacuacggcuucgggguguucaccaccaacaucuggcugaagcuccgggacagcuacacgcagaugugcgaccaccgccugauguccgccgcgaucaaggacagcaaggccgugcacgccgacaugggcuacuggaucgaguccgagaagaacgagaccuggaagcuggcccgggccagcuucaucgaggucaagaccugcaucuggccccgcucccacacccucuggagcaacggcgugcuggaguccgagaugaucauccccaagaucuacgggggcccgaucagccagcacaacuaccggcccggguacuucacgcagaccgcgggccccuggcaccuggggaagcucgagcuggacuucgaccugugcgagggcaccaccguggucguggacgagcacugcggcaaccgcgggccgucccuccggacgaccaccgugaccggcaagaucauccacgaguggugcugccgcagcugcacgcugccgccccugcgguuccgcggggaggacggcugcugguacgggauggagauccggcccgucaaggagaaggaggagaaccucgugcgcuccauggugagcgccggcuccggcgaggucgacagcuucagccuggggcugcucugcguguccaucaugaucgaggaggugaugcggagccgcuggucccgcaagaugcugaugaccggcacccuggccgucuucuuccuccugaucauggggcagcugaccuggaacgaccucauccggcugugcaucauggugggcgccaacgugagcgaccgcauggggaugggcacgaccuaccuggcccucauggcgaccuucaagaugcggccgauguucgccgucgggcugcuguuccgccggcucaccucccgcgaggugcugcugcucacgaucgggcugagccuggucgccuccguggagcuccccaacagccuggaggagcugggcgacgggcucgccaugggcaucaugaugcugaagcugcucaccgacuuccagccccaccagcuguggaccacccugcucucccugacguucaucaagaccacccugagccucgacuacgccuggaagaccauggcgauggugcuguccaucgucagccuguucccccucugccuguccacgaccagccagaagaccaccuggcugccggugcuccugggcuccuucgggugcaagccccugaccauguuccucaucacggagaacaagaucuggggccgcaagagcuggccccugaacgaggggaucauggccgugggcaucgucuccauccugcucagcucccugcugaagaacgacgugccccucgccgggccgcugaucgccggcggcaugcugaucgcgugcuacgugaucagcgggagcuccgccgaccucagccuggagcgcgccgccgaggucuccugggaggaggaggccgagcacagcggcgcgucccacaacauccugguggaggugcaggacgacgggaccaugaagaucaaggacgaggagcgggacgacacccucaccauccugcugaaggccacgcuccuggccgucagcggcguguaccccauguccauccccgccacccuguucgugugguacuucuggcagaagaagaagcagcgcagcgggguccucugggacacccccuccccgcccgagguggagcgggccgugcuggacgacggcaucuaccgcauccugcagcggggccugcucgggcgcagccaggucggcguggggguguuccaggacggcgucuuccacaccauguggcacgugacgcgcggggcggugcugauguaccagggcaagcgccuggagcccuccugggccagcgucaagaaggaccucaucuccuacggcgggggcuggcgguuccaggggagcuggaacaccggcgaggagguccaggugaucgccgucgagcccgggaagaacccgaagaacgugcagaccacccccggcacguucaagacccccgagggcgaggugggggccaucgcccuggacuucaagcccggcaccuccgggagcccgaucgucaaccgcgagggcaagaucgugggccuguacgggaacggcguggucaccacguccgggaccuacgugagcgcgaucgcccaggccaaggccucccaggagggcccccuccccgagaucgaggacgagguguucaagaagcggaaccugaccaucauggaccugcacccggggagcggcaagacccgccgguaccuccccgccaucguccgcgaggcgaucaagcgcaagcugcggacgcugauccucgcccccacccgcgugguggccagcgagauggccgaggcgcugaagggcaugcccauccgguaccagaccaccgccgucaaguccgagcacacggggaaggagaucguggaccugaugugccacgccaccuucaccaugcgccuccugagcccggugcggguccccaacuacaacaugaucaucauggacgaggcccacuucaccgaccccgccuccaucgcggcccgcggcuacaucagcacgcggguggggaugggcgaggccgccgccaucuucaugaccgcgacgccgcccggguccguggaggccuucccccagagcaacgccgucauccaggacgaggagcgcgacauccccgagcgguccuggaacagcggcuacgacuggaucaccgacuuccccggcaagacggugugguucgugcccuccaucaagagcgggaacgacaucgccaacugccugcgcaagaacggcaagcgggucauccagcucucccgcaagaccuucgacaccgaguaccagaagaccaagaacaacgacugggacuacguggugacgaccgacaucagcgagaugggggccaacuuccgggcggaccgcgucaucgacccccggcgcugccugaagcccgugauccugaaggacggccccgagcgggucauccucgccgggccgaugcccgugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacgcccgaggggaucaucccggcccuguucgagcccgagcgggagaaguccgcggccaucgacggcgaguaccgccugcgcggggaggcccgcaagaccuucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccgcucgcgcugcgcgaguucaaggaguucgccgccgggcggcgcuccgugagcggcgaccugauccucgagaucggcaagcugccccagcaccugacccuccgggcccagaacgcccuggacaaccuggugaugcuccacaacagcgagcagggcgggaaggcguaccgccacgccauggaggagcugcccgacacgaucgagacccugaugcuccuggcccugaucgccguccucaccgggggcgugacccuguucuuccuguccgggaagggccucggcaagacgagcaucgggcugcugugcgugauggcguccagcguccuccuguggauggccuccguggagccccacuggaucgccgccagcaucauccuggaguucuuccucauggugcugcugaucccggagcccgaccggcagcgcacgccccaggacaaccagcucgccuacgucgugaucggccugcuguucaugauccucaccguggcggccaacgagauggggcugcuggagaccacgaagaaggaccucggcaucgggcacgucguggccgagaaccaccaccacgccaccaugcuggacaucgaccugcacccggccuccgcguggacccucuacgccguggccaccacgaucaucacccccaugaugcggcacaccaucgagaacaccacggccaacaucagccugaccgccaucgcgaaccaggccgccauccugaugggccucgacaagggcuggcccaucuccaagauggacaucggggucccccugcuggcccucggcugcuacagccaggugaacccgcugacccugaccgccgcggugcucaugcuggucgcccacuacgccaucaucgggcccggccugcaggccaaggcgacgcgcgaggcccagaagcgcaccgccgccgggaucaugaagaaccccaccguggacggcaucguggccaucgaccucgaccccgucguguacgacgcgaaguucgagaagcagcugggccagaucaugcugcucauccugugcaccucccagauccugcucaugcggacgaccugggcccugugcgagagcaucacccuggccaccgggccgcucacgacccugugggagggcucccccgggcgcuucuggaacaccaccaucgccgugagcauggccaacaucuuccggggcuccuaccuggcgggcgccgggcucgccuucagccugaugaagucccugggcgggggccgccgggggacgggcgcccagggcgagacccucggggagaaguggaagcgccagcugaaccagcugagcaaguccgaguucaacaccuacaagcggagcggcaucauggaggucgaccgcagcgaggccaaggaggggcucaagcggggcgagaccacgaagcacgcggugucccgcgggaccgccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagccgauccccauggccaccuacggcuggaacaucgugaagcugcacuccgggcgcgacguguucuucacgccgcccgagaagugcgacacccugcucugcgacaucggcgagagcuccccgaaccccaccaucgaggaggggcggacccugcgcguccugaagaugguggagcccuggcuccggggcaaccaguucugcaucaagauccugaaccccuacaugccgagcguggucgagacgcuggagcagaugcagcgcaagcacggcgggaugcucgugcggaacccccugucccgcaacagcacccacgagauguacuggguguccugcggcaccgggaacaucgucagcgcggugaacaugaccucccgcaugcugcucaaccgguucacgauggcccaccgcaagcccaccuacgagcgggacguggaccugggcgccggcacccgccacgucgccguggagcccgagaucgccaaccuggacaucaucgggcagcggaucgagaacaucaagaacgagcacaagagcaccuggcacuacgacgaggacaacccguacaagacgugggcguaccacggcuccuacgaggugaagcccagcggguccgccagcuccauggucaacggcgugguccgccuccugaccaagcccugggacgugauccccauggugacccagaucgccaugaccgacacgaccccguucgggcagcagcgggucuucaaggagaagguggacacccgcacgccccggcccaagcgcggcacggcccagaucauggaggugaccgccaaguggcuguggggcuuccucagccggaacaagaagccgcgcaucugcacccgggaggaguucacccgcaagguccgguccaacgcggccaucggggccguguucguggacgagaaccaguggaacagcgccaaggaggccgucgaggacgagcgcuucugggaccuggugcaccgggagcgcgagcugcacaagcagggcaagugcgcgacgugcguguacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcgucgagggggagggccugcacaagcucggguacauccugcgcgacaucagcaagauccccggcggcaacauguacgccgacgacaccgccgggugggacacccggaucaccgaggacgaccugcagaacgaggccaagaucacggacaucauggagcccgagcacgcccuccuggcgaccuccaucuucaagcugaccuaccagaacaagguggugcgcguccagcggcccgccaagagcggcaccgugauggacgugaucucccgccgggaccagcgcgggagcggccaggucggcacguacgggcucaacaccuucaccaacauggaggugcagcugauccggcagauggaguccgagggcaucuucagcccguccgagcuggagaacagcaaccucgccgagcgcgugcuggacuggcuggagaagcacggggucgagcggcucaagcgcauggccaucuccggcgacgacugcguggugaagcccaccgacgaccgguucgccacggcgcugaccgcccugaacgacauggggaagguccgcaaggacaucccccagugggagcccagcaagggcuggaacgacuggcagcaggucccguucugcucccaccacuuccaccagcucaucaugaaggacggccgggagaucgugguccccugccgcaaccaggacgagcugguggggcgggcccgcgugagccagggcgccggguggucccugcgggagaccgccugccucggcaagagcuacgcgcagauguggcagcugauguacuuccaccgccgggaccugcgccucgccgccaacgccaucugcagcgccguccccgugaacugggugcccaccucccgcaccacguggagcauccacgcgcaccaccaguggaugaccaccgaggacaugcuguccgucuggaaccggguguggaucgaggagaacccguggauggaggacaagacccacgugagcuccugggaggacguccccuaccuggggaagcgcgaggaccaguggugcggcagccucaucggccugacggcccgggccaccugggccaccaacauccagguggcgaucaaccaggugcgccggcugaucgggaacgagaacuaccucgacuacaugaccuccaugaagcgcuucaagaacgagagcgaccccgagggcgcccugugguga

SEQ ID NO: 7950 - RNA, 9879 nt, Artificial Sequence
  derived and/or modified CDS sequence (opt1) from DENV-1__KX380799__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccgucuucuuccuccugaucauggggcagcugaccuggaacgaccucauccggcugugcaucauggugggcgccaacguguccgaccgcauggggaugggcaccacguaccuggcccucauggcgaccuucaagaugcggccgauguucgccgucgggcugcuguuccgccggcucaccagccgcgaggugcugcugcucaccaucgggcugucccuggucgccagcguggagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggcuccuucgggugcaagccgcugaccauguuccucaucaccgagaacaagaucuggggccgcaagagcuggccccugaacgaggggaucauggccgugggcaucgucuccauccugcucagcagccugcugaagaacgacgugccccucgccgggccccugaucgccggcggcaugcugaucgcgugcuacgugaucuccgggagcuccgccgaccucagccuggagcgcgccgccgaggucuccugggaggaggaggccgagcacagcggcgcgucccacaacauccugguggaggugcaggacgacgggacgaugaagaucaaggacgaggagcgggacgacacccucaccauccugcugaaggccacccuccuggccgucagcggcguguacccgauguccauccccgccacgcuguucgugugguacuucuggcagaagaagaagcagcgcagcgggguccucugggacacccccagcccgcccgagguggagcgggccgugcuggacgacggcaucuaccgcauccugcagcggggccugcucgggcgcagccaggucggcguggggguguuccaggacggcgucuuccacaccauguggcacgugacccgcggggcggugcugauguaccagggcaagcgccuggagcccuccugggccagcgucaagaaggaccucaucuccuacggcgggggcuggcgguuccaggggagcuggaacacgggcgaggagguccaggugaucgccgucgagcccgggaagaaccccaagaacgugcagaccacccccggcaccuucaagacgcccgagggcgaggugggggccaucgcccuggacuucaagcccggcaccuccgggagccccaucgucaaccgcgagggcaagaucgugggccuguacgggaacggcguggucaccaccuccgggacguacgugagcgcgaucgcccaggccaaggccagccaggagggcccgcuccccgagaucgaggacgagguguucaagaagcggaaccugaccaucauggaccugcaccccggguccggcaagacccgccgguaccucccggccaucguccgcgaggcgaucaagcgcaagcugcggacccugauccucgcccccacgcgcgugguggccagcgagauggccgaggcgcugaagggcaugcccauccgguaccagaccaccgccgucaaguccgagcacaccgggaaggagaucguggaccugaugugccacgccacguucaccaugcgccuccugagccccgugcgggucccgaacuacaacaugaucaucauggacgaggcccacuucaccgaccccgccuccaucgcggcccgcggcuacaucagcacccggguggggaugggcgaggccgccgccaucuucaugacggcgacgccgcccggguccguggaggccuucccgcagagcaacgccgucauccaggacgaggagcgcgacauccccgagcgguccuggaacagcggcuacgacuggaucaccgacuuccccggcaagaccgugugguucgugcccuccaucaagagcgggaacgacaucgccaacugccugcgcaagaacggcaagcgggucauccagcucucccgcaagacguucgacaccgaguaccagaagaccaagaacaacgacugggacuacguggugaccacggacaucagcgagaugggggccaacuuccgggcggaccgcgucaucgacccgcggcgcugccugaagcccgugauccugaaggacggccccgagcgggucauccucgccgggcccaugccggugaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcuguccuacaagguggccagcgagggcuuccaguacuccgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccgggcggcgcagcguguccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccgggggcgugacccuguucuuccuguccgggaagggccucggcaagaccagcaucgggcugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggucccccugcuggcccucggcugcuacagccaggugaacccccugacccugaccgccgcggugcucaugcuggucgcccacuacgccaucaucgggccgggccugcaggccaaggcgacccgcgaggcccagaagcgcacggccgccgggaucaugaagaaccccaccguggacggcaucguggccaucgaccucgaccccgucguguacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggcgcuucuggaacaccaccaucgccgugagcauggccaacaucuuccggggcuccuaccuggcgggcgccgggcucgccuucagccugaugaagucccugggcgggggccgccgggggaccggcgcccagggcgagacgcucggggagaaguggaagcgccagcugaaccagcugagcaagagcgaguucaacaccuacaagcgguccggcaucauggaggucgaccgcagcgaggccaaggaggggcucaagcggggcgagaccaccaagcacgcggugucccgcgggacggccaagcugcggugguucguggagcgcaaccuggucaagcccgagggcaaggugaucgaccugggcugcgggcggggcggguggagcuacuacugcgccggccucaagaaggugaccgaggucaagggguacaccaagggcggccccgggcacgaggagcccaucccgauggccaccuacggcuggaacaucgugaagcugcacuccgggcgcgacguguucuucacgccgcccgagaagugcgacacgcugcucugcgacaucggcgagagcucccccaacccgaccaucgaggaggggcggacccugcgcguccugaagaugguggagcccuggcuccggggcaaccaguucugcaucaagauccugaaccccuacaugcccagcguggucgagacccuggagcagaugcagcgcaagcacggcgggaugcucgugcggaacccgcugucccgcaacagcacgcacgagauguacuggguguccugcggcaccgggaacaucgucagcgcggugaacaugaccucccgcaugcugcucaaccgguucaccauggcccaccgcaagcccacguacgagcgggacguggaccugggcgccggcacccgccacgucgccguggagcccgagaucgccaaccuggacaucaucgggcagcggaucgagaacaucaagaacgagcacaagagcaccuggcacuacgacgaggacaaccccuacaagaccugggcguaccacggcuccuacgaggugaagccgagcggguccgccagcuccauggucaacggcgugguccgccuccugacgaagcccugggacgugauccccauggugacccagaucgccaugaccgacaccacgcccuucgggcagcagcgggucuucaaggagaagguggacacccgcaccccgcggcccaagcgcggcaccgcccagaucauggaggugacggccaaguggcuguggggcuuccucagccggaacaagaagccccgcaucugcacccgggaggaguucacccgcaagguccggagcaacgcggccaucggggccguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgccaucugguacauguggcugggcgcccgguuccuggaguucgaggcgcucggguucaugaacgaggaccacugguucucccgcgagaacagccuguccggcgucgagggggagggccugcacaagcucggguacauccugcgcgacaucagcaagaucccgggcggcaacauguacgccgacgacacggccgggugggacacccggaucaccgaggacgaccugcagaacgaggccaagaucaccgacaucauggagcccgagcacgcccuccuggcgacguccaucuucaagcugaccuaccagaacaagguggugcgcguccagcggcccgccaagagcggcaccgugauggacgugaucucccgccgggaccagcgcgggagcggccaggucggcaccuacgggcucaacacguucaccaacauggaggugcagcugauccggcagauggaguccgagggcaucuucagccccuccgagcuggagaacagcaaccucgccgagcgcgugcuggacuggcuggagaagcacggggucgagcggcucaagcgcauggccaucuccggcgacgacugcguggugaagccgaccgacgaccgguucgccaccgcgcugacggcccugaacgacauggggaagguccgcaaggacaucccccagugggagcccagcaagggcuggaacgacuggcagcagguccccuucugcucccaccacuuccaccagcucaucaugaaggacggccgggagaucguggucccgugccgcaaccaggacgagcugguggggcgggcccgcgugagccagggcgccggguggagccugcgggagaccgccugccucggcaaguccuacgcgcagauguggcagcugauguacuuccaccgccgggaccugcgccucgccgccaacgccaucugcagcgccguccccgugaacugggugcccaccucccgcaccaccuggagcauccacgcgcaccaccaguggaugacgaccgaggacaugcuguccgucuggaaccggguguggaucgaggagaaccccuggauggaggacaagacccacgugagcuccugggaggacgucccguaccuggggaagcgcgaggaccaguggugcggcagccucaucggccugaccgcccgggccacgugggccaccaacauccagguggcgaucaaccaggugcgccggcugaucgggaacgagaacuaccucgacuacaugaccuccaugaagcgcuucaagaacgagagcgaccccgagggcgcccugugguga

SEQ ID NO: 7951 - RNA, 9879 nt, Artificial Sequence
  derived and/or modified CDS sequence (opt1) from DENV-1__KX380800__SS-prME
agcgugaccaugcugcucaugcugcugcccaccgcccucgccuuccaccugaccacccggggcggggagccccacaugaucgugagcaagcaggagcggggcaagagccuccuguucaagaccuccgcgggggugaacaugugcacccugaucgccauggaccugggcgagcucugcgaggacacgaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaaggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucugcgugagcaucaugaucgaggaggugaugcggucccgcuggagccgcaagaugcugaugacgggcacccuggccaucuucuuccuccugaucauggggcagcugaccuggaacgaccucauccggcugugcaucauggucggcgccaacguguccgaccgcauggggaugggcaccacguaccuggcccucauggcgaccuucaagaugcggccgauguucgccguggggcugcuguuccgccggcucaccagccgcgagguccugcugcucaccaucgggcugucccugguggccagcgucgagcuccccaacucccuggaggagcugggcgacgggcucgccaugggcaucaugaugcugaagcugcucacggacuuccagagccaccagcuguggaccacccugcucucccugaccuucaucaagacgacccugagccucgacuacgccuggaagaccauggcgauggugcuguccaucgugagccuguucccccucugccuguccaccacgagccagaagaccaccuggcugcccguccuccugggcuccuucgggugcaagccgcugaccauguuccucaucaccgagaacaagaucuggggccgcaagagcuggccccugaacgaggggaucauggccgugggcaucguguccauccugcucagcagccugcugaagaacgacgucccccucgccgggccccugaucgccggcggcaugcugaucgcgugcuacgugaucuccgggagcuccgccgaccucagccuggagcgcgccgccgagguguccugggaggaggaggccgagcacagcggcgcgucccacaacauccuggucgaggugcaggacgacgggacgaugaagaucaaggacgaggagcgggacgacacccucaccauccugcugaaggccacccuccuggccgugagcggcgucuacccgauguccauccccgccacgcuguucgugugguacuucuggcagaagaagaagcagcgcagcggggugcucugggacacccccagcccgcccgaggucgagcgggccgugcuggacgacggcaucuaccgcauccugcagcggggccugcucgggcgcagccaggugggcgucgggguguuccaggacggcguguuccacaccauguggcacgucacccgcggggcggugcugauguaccagggcaagcgccuggagcccuccugggccagcgugaagaaggaccucaucuccuacggcgggggcuggcgguuccaggggagcuggaacacgggcgaggagguccaggugaucgccguggagcccgggaagaaccccaagaacguccagaccacccccggcaccuucaagacgcccgagggcgaggugggggccaucgcccuggacuucaagcccggcaccuccgggagccccaucgugaaccgcgagggcaagaucgucggccuguacgggaacggcguggugaccaccuccgggacguacgucagcgcgaucgcccaggccaaggccagccaggagggcccgcuccccgagaucgaggacgagguguucaagaagcggaaccugaccaucauggaccugcaccccggguccggcaagacccgccgguaccucccggccaucgugcgcgaggcgaucaagcgcaagcugcggacccugauccucgcccccacgcgcgucguggccagcgagauggccgaggcgcugaagggcaugcccauccgguaccagaccaccgccgugaaguccgagcacaccgggaaggagaucgucgaccugaugugccacgccacguucaccaugcgccuccugagccccgugcgggugccgaacuacaacaugaucaucauggacgaggcccacuucaccgaccccgccuccaucgcggcccgcggcuacaucagcacccgggucgggaugggcgaggccgccgccaucuucaugacggcgacgccgcccggguccguggaggccuucccgcagagcaacgccgugauccaggacgaggagcgcgacauccccgagcgguccuggaacagcggcuacgacuggaucaccgacuuccccggcaagaccgucugguucgugcccuccaucaagagcgggaacgacaucgccaacugccugcgcaagaacggcaagcgggugauccagcucucccgcaagacguucgacaccgaguaccagaagaccaagaacaacgacugggacuacgucgugaccacggacaucagcgagaugggggccaacuuccgggcggaccgcgugaucgacccgcggcgcugccugaagcccgucauccugaaggacggccccgagcgggugauccucgccgggcccaugccggucaccgccgccuccgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccguguggcuguccuacaaggucgccagcgagggcuuccaguacuccgaccggcgcuggugcuucgacggggagcggaacaaccaggugcucgaggagaacauggacguggagaucuggaccaaggagggcgagcgcaagaagcugcggccccgcuggcuggacgcccggaccuacagcgacccccucgcgcugcgcgaguucaaggaguucgccgccgggcggcgcagcgucuccggcgaccugauccucgagaucggcaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccgugcucaccgggggcgucacccuguucuuccuguccgggaagggccucggcaagaccagcaucgggcugcugugcgugauggcguccagcgugcuccuguggauggccuccgucgagccccacuggaucgccgccagcaucauccuggaguucuuccucauggugcugcugauccccgagccggaccggcagcgcacgccccaggacaaccagcucgccuacguggucaucggccugcuguucaugauccucaccguggcggccaacgagauggggcugcuggagaccaccaagaaggaccucggcaucgggcacguggucgccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggcuggcccaucuccaagauggacaucggggugccccugcuggcccucggcugcuacagccaggucaacccccugacccugaccgccgcggugcucaugcugguggcccacuacgccaucaucgggccgggccugcaggccaaggcgacccgcgaggcccagaagcgcacggccgccgggaucaugaagaaccccaccgucgacggcaucguggccaucgaccucgaccccguggucuacgacgcgaaguucgagaagcagcugggccagaucaugcugcucauccugugcaccucccagauccugcucaugcggaccacgugggcccugugcgagagcaucacccuggccaccgggccccucaccacgcugugggagggcuccccggggaaguucuggaacaccaccaucgccgugagcauggccaacaucuuccgcggcuccuaccuggcgggcgccgggcucgccuucagccugaugaagucccugggcgggggccggcgcgggaccggcgcccagggcgagacgcucggggagaaguggaagcggcagcugaaccagcugagcaagagcgaguucaacaccuacaagcgcuccggcaucauggagguggaccggagcgaggccaaggaggggcucaagcgcggcgagaccaccaagcacgcggucucccgggggacggccaagcugcgcugguucguggagcggaaccuggugaagcccgagggcaaggucaucgaccugggcugcgggcgcggcggguggagcuacuacugcgccggccucaagaaggugaccgaggugaagggguacaccaagggcggccccgggcacgaggagcccaucccgauggccaccuacggcuggaacaucgucaagcugcacuccgggcgggacguguucuucacgccgcccgagaagugcgacacgcugcucugcgacaucggcgagagcucccccaacccgaccaucgaggaggggcgcacccugcgggugcugaagauggucgagcccuggcuccgcggcaaccaguucugcaucaagauccugaaccccuacaugcccagcgugguggagacccuggagcagaugcagcggaagcacggcgggaugcucguccgcaacccgcugucccggaacagcacgcacgagauguacuggguguccugcggcaccgggaacaucgugagcgcggucaacaugaccucccgcaugcugcucaaccgcuucaccauggcccaccggaagcccacguacgagcgcgacguggaccugggcgccggcacccggcacguggccgucgagcccgagaucgccaaccuggacaucaucgggcagcgcaucgagaacaucaagaacgagcacaagagcaccuggcacuacgacgaggacaaccccuacaagaccugggcguaccacggcuccuacgaggugaagccgagcggguccgccagcuccauggugaacggcgucgugcggcuccugacgaagcccugggacgucauccccauggugacccagaucgccaugaccgacaccacgcccuucgggcagcagcgcguguucaaggagaaggucgacacccggaccccgcgccccaagcggggcaccgcccagaucauggaggugacggccaaguggcuguggggcuuccucagccgcaacaagaagccccggaucugcacccgcgaggaguucacccggaaggugcgcagcaacgcggccaucggggccgucuucguggacgagaaccaguggaacuccgccaaggaggccguggaggacgagcgguucugggaccugguccaccgcgagcgggagcugcacaagcagggcaagugcgcgaccugcguguacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacacggccgggugggacacccgcaucaccgaggacgaccugcagaacgaggccaagaucaccgacaucauggagcccgagcacgcccuccuggcgacguccaucuucaagcugaccuaccagaacaaggucgugcgggugcagcgccccgccaagagcggcaccgucauggacgugaucucccggcgcgaccagcgggggagcggccaggugggcaccuacgggcucaacacguucaccaacauggagguccagcugauccgccagauggaguccgagggcaucuucagccccuccgagcuggagaacagcaaccucgccgagcgggugcuggacuggcuggagaagcacgggguggagcgccucaagcggauggccaucuccggcgacgacugcgucgugaagccgaccgacgaccgcuucgccaccgcgcugacggcccugaacgacauggggaaggugcggaaggacaucccccagugggagcccagcaagggcuggaacgacuggcagcagguccccuucugcucccaccacuuccaccagcucaucaugaaggacggccgcgagaucguggugccgugccggaaccaggacgagcuggucgggcgcgcccgggugagccagggcgccggguggagccugcgcgagaccgccugccucggcaaguccuacgcgcagauguggcagcugauguacuuccaccggcgcgaccugcggcucgccgccaacgccaucugcagcgccgugcccgucaacugggugcccaccucccgcaccaccuggagcauccacgcgcaccaccaguggaugacgaccgaggacaugcuguccguguggaaccgcgucuggaucgaggagaaccccuggauggaggacaagacccacgugagcuccugggaggacgugccguaccuggggaagcgggaggaccaguggugcggcagccucaucggccugaccgcccgcgccacgugggccaccaacauccaggucgcgaucaaccaggugcggcgccugaucgggaacgagaacuaccucgacuacaugaccuccaugaagcgguucaagaacgagagcgaccccgagggcgcccugugguga

SEQ ID NO: 7952 - RNA, 9879 nt, Artificial Sequence
  derived and/or modified CDS sequence (opt1) from DENV-1__KX380802__SS-prME
agcgugaccaugcugcucaugcugcugcccaccgcccucgccuuccaccugaccacccgcggcggggagccccacaugaucgugagcaagcaggagcggggcaagagccugcuguucaagaccuccgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagaugggcaagcucacccugaagggggucuccuacgugaugugcaccggcagcuucaagcuggagaaggagguggcggagacccagcacggcacgguccugguccaggugaaguacgaggggaccgacgcccccugcaagauccccaucuccacccaggacgagaagggcgucacccagaacgggcggcucaucacggccaacccgaucgugaccgacaaggagaagcccgugaacaucgagaccgagccgcccuucggcgagagcuacaucgucaucggcgccggggagaaggcgcugaagcuguccugguucaagaagggcagcuccaucgggaagauguucgaggccaccgcccgcggcgcccggcgcauggccauccucggggacacggcgugggacuucggcagcaucggcgggguguucaccuccgugggcaagcugguccaccagguguucgggaccgccuacggcgugcuguucagcggggucuccuggaccaugaagaucggcaucggcauccuccugacguggcuggggcucaacagccgcuccaccagccuguccaugaccugcaucgccgugggcauggugacccuguaccucggggucauggugcaggccgacagcggcugcgugaucaacuggaaggggcgggagcugaagugcggcuccggcaucuucgucacgaacgaggugcacaccuggaccgagcaguacaaguuccaggccgacagcccgaagcgccugagcgcggccaucgggaaggccugggaggagggcgugugcgggauccgguccgccacccgccucgagaacaucauguggaagcagaucagcaacgagcugaaccacauccugcucgagaacgacaugaaguucaccgucguggugggcgacgccaacgggauccugacgcagggcaagaagaugauccggccccagcccauggagcacaaguacuccuggaaguccuggggcaaggcgaagaucaucggggccgacacccagaacaccaccuucaucaucgacggccccgacacgccggagugccccgacgaccagcgcgccuggaacaucugggaggucgaggacuacggguucggcguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggggugcuggagagcgagaugaucauccccaagaucuacggcgggccgaucucccagcacaacuaccggcccggcuacuucacccagacggcggggcccuggcaccugggcaagcucgagcuggacuucaaccugugcgagggcaccaccguggucguggacgagcacugcgggaaccgcggcccgagccuccggaccacgaccgugaccgggaagaucauccacgaguggugcugccgcuccugcacccugccgccccugcgguuccgcggcgaggacgggugcugguacggcauggagauccggcccgucaaggagaaggaggagaaccucgugcgcagcaugguguccgccggcagcggggaggucgacagcuucucccugggccugcucugcgugagcaucaugaucgaggaggugaugcggucccgcuggagccgcaagaugcugaugacggggacccuggccgucuucuuccuccugaucaugggccagcugaccuggaacgaccucauccggcugugcaucauggugggggccaacguguccgaccgcaugggcaugggcaccacguaccuggcccucauggcgaccuucaagaugcggccgauguucgccgucgggcugcuguuccgccggcucaccagccgcgaggugcugcugcucaccaucggccugucccuggucgccagcguggagcuccccaacucccuggaggagcugggggacggccucgccaugggcaucaugaugcugaagcugcucacggacuuccagagccaccagcuguggaccacccugcucucccugaccuucaucaagacgacccugagccucgacuacgccuggaagaccauggcgauggugcuguccaucgucagccuguucccccucugccuguccaccacgagccagaagaccaccuggcugcccgugcuccugggguccuucggcugcaagccgcugaccauguuccucaucaccgagaacaagaucugggggcgcaagagcuggccccugaacgagggcaucauggccguggggaucgucuccauccugcucagcagccugcugaagaacgacgugccccucgccggcccccugaucgccggcgggaugcugaucgcgugcuacgugaucuccggcagcuccgccgaccucagccuggagcgcgccgccgaggucuccugggaggaggaggccgagcacagcggggcgucccacaacauccugguggaggugcaggacgacggcacgaugaagaucaaggacgaggagcgggacgacacccucaccauccugcugaaggccacccuccuggccgucagcgggguguacccgauguccauccccgccacgcuguucgugugguacuucuggcagaagaagaagcagcgcagcggcguccucugggacacccccagcccgcccgagguggagcgggccgugcuggacgacggcaucuaccgcauccugcagcgggggcugcucggccgcagccaggucggggugggcguguuccaggacggggucuuccacaccauguggcacgugacccggggcgcggugcugauguaccagggcaagcgccuggagcccuccugggccagcgucaagaaggaccucaucuccuacgggggcggguggcgguuccagggcagcuggaacacgggggaggagguccaggugaucgccgucgagcccggcaagaaccccaagaacgugcagaccacccccggcaccuucaagacgcccgagggggaggugggcgccaucgcccuggacuucaagcccgggaccuccggcagccccaucgucaaccgcgagggcaagaucguggggcuguacggcaacgggguggucaccaccuccggcacguacgugagcgcgaucgcccaggccaaggccagccaggaggggccgcuccccgagaucgaggacgagguguucaagaagcggaaccugaccaucauggaccugcaccccggcuccggcaagacccgccgguaccucccggccaucguccgcgaggcgaucaagcgcaagcugcggacccugauccucgcccccacgcgcgugguggccagcgagauggccgaggcgcugaaggggaugcccauccgguaccagaccaccgccgucaaguccgagcacaccggcaaggagaucguggaccugaugugccacgccacguucaccaugcgccuccugagccccgugcgggucccgaacuacaacaugaucaucauggacgaggcccacuucaccgaccccgccuccaucgcggcccgcggguacaucagcacccgggugggcaugggggaggccgccgccaucuucaugacggcgacgccgcccggcuccguggaggccuucccgcagagcaacgccgucauccaggacgaggagcgcgacauccccgagcgguccuggaacagcggcuacgacuggaucaccgacuuccccgggaagaccgugugguucgugcccuccaucaagagcggcaacgacaucgccaacugccugcgcaagaacgggaagcgggucauccagcucucccgcaagacguucgacaccgaguaccagaagaccaagaacaacgacugggacuacguggugaccacggacaucagcgagaugggcgccaacuuccgggcggaccgcgucaucgacccgcggcgcugccugaagcccgugauccugaaggacgggcccgagcgggucauccucgccggccccaugccggugaccgccgccuccgcggcccagcgccggggccgcaucgggcgcaaccagaacaaggagggcgaccaguacaucuacauggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugcggggcgaggcccgcaagacguucguggagcucaugcggcgcggcgaccugcccgucuggcuguccuacaagguggccagcgagggguuccaguacuccgaccggcgcuggugcuucgacggcgagcggaacaaccaggugcucgaggagaacauggacgucgagaucuggaccaaggagggggagcgcaagaagcugcggccccgcuggcuggacgcccggaccuacagcgacccccucgcgcugcgcgaguucaaggaguucgccgccggccggcgcagcguguccggcgaccugauccucgagaucgggaagcugccgcagcaccugacccuccgggcccagaacgcccuggacaaccuggugaugcuccacaacagcgagcagggcgggaaggcguaccgccacgccauggaggagcugcccgacaccaucgagacgcugaugcuccuggcccugaucgccguccucaccggcggggugacccuguucuuccuguccggcaagggccucgggaagaccagcaucggccugcugugcgugauggcguccagcguccuccuguggauggccuccguggagccccacuggaucgccgccagcaucauccuggaguucuuccucauggugcugcugauccccgagccggaccggcagcgcacgccccaggacaaccagcucgccuacgucgugaucgggcugcuguucaugauccucaccguggcggccaacgagaugggccugcuggagaccaccaagaaggaccucgggaucggccacgucguggccgagaaccaccaccacgccacgaugcuggacaucgaccugcaccccgccuccgcguggacccucuacgccguggccaccaccaucaucacgccgaugaugcggcacaccaucgagaacaccaccgccaacaucagccugacggccaucgcgaaccaggccgccauccugaugggccucgacaagggguggcccaucuccaagauggacaucggcgucccccugcuggcccucgggugcuacagccaggugaacccccugacccugaccgccgcggugcucaugcuggucgcccacuacgccaucaucggcccggggcugcaggccaaggcgacccgcgaggcccagaagcgcacggccgccggcaucaugaagaaccccaccguggacggcaucguggccaucgaccucgaccccgucguguacgacgcgaaguucgagaagcagcuggggcagaucaugcugcucauccugugcaccucccagauccugcucaugcggaccacgugggcccugugcgagagcaucacccuggccaccggcccccucaccacgcugugggagggguccccgggcaaguucuggaacaccaccaucgccgugagcauggccaacaucuuccgcggcuccuaccuggcgggggccggccucgccuucagccugaugaagucccucgggggcgggcggcgcgggaccggcgcccagggggagacgcucggcgagaaguggaagcggcagcugaaccagcugagcaagagcgaguucaacaccuacaagcgcuccgggaucauggaggucgaccggagcgaggccaaggagggccucaagcgcggggagaccaccaagcacgcggugucccggggcacggccaagcugcgcugguucguggagcggaaccuggucaagcccgagggcaaggugaucgaccuggggugcggccgcgggggcuggagcuacuacugcgccgggcucaagaaggugaccgaggucaagggcuacaccaagggcgggcccggccacgaggagcccaucccgauggccaccuacggguggaacaucgugaagcugcacuccggccgggacguguucuucacgccgcccgagaagugcgacacgcugcucugcgacaucggggagagcucccccaacccgaccaucgaggagggccgcacccugcggguccugaagaugguggagcccuggcuccgcggcaaccaguucugcaucaagauccugaaccccuacaugcccagcguggucgagacccuggagcagaugcagcggaagcacgggggcaugcucgugcgcaacccgcugucccggaacagcacgcacgagauguacuggguguccugcgggaccggcaacaucgucagcgcggugaacaugaccucccgcaugcugcucaaccgcuucaccauggcccaccggaagcccacguacgagcgcgacguggaccugggcgccgggacccggcacgucgccguggagcccgagaucgccaaccuggacaucaucggccagcgcaucgagaacaucaagaacgagcacaagagcaccuggcacuacgacgaggacaaccccuacaagaccugggcguaccacggguccuacgaggugaagccgagcggcuccgccagcuccauggucaacggggugguccggcuccugacgaagcccugggacgugauccccauggugacccagaucgccaugaccgacaccacgcccuucggccagcagcgcgucuucaaggagaagguggacacccggaccccgcgccccaagcggggcaccgcccagaucauggaggugacggccaaguggcuguggggguuccucagccgcaacaagaagccccggaucugcacccgcgaggaguucacccggaagguccgcagcaacgcggccaucggcgccguguucguggacgagaaccaguggaacuccgccaaggaggccgucgaggacgagcgguucugggaccuggugcaccgcgagcgggagcugcacaagcaggggaagugcgcgaccugcguguacaacaugaugggcaagcgcgagaagaagcucggggaguucggcaaggccaagggcagccgggccaucugguacauguggcugggggcccgcuuccuggaguucgaggcgcucggcuucaugaacgaggaccacugguucucccgggagaacagccuguccggggucgagggcgaggggcugcacaagcucggcuacauccugcgcgacaucagcaagaucccgggcgggaacauguacgccgacgacacggccggcugggacacccgcaucaccgaggacgaccugcagaacgaggccaagaucaccgacaucauggagcccgagcacgcccuccuggcgacguccaucuucaagcugaccuaccagaacaagguggugcggguccagcgccccgccaagagcgggaccgugauggacgugaucucccggcgcgaccagcggggcagcggccaggucgggaccuacggccucaacacguucaccaacauggaggugcagcugauccgccagauggaguccgaggggaucuucagccccuccgagcuggagaacagcaaccucgccgagcgggugcuggacuggcuggagaagcacggcgucgagcgccucaagcggauggccaucuccggggacgacugcguggugaagccgaccgacgaccgcuucgccaccgcgcugacggcccugaacgacaugggcaagguccggaaggacaucccccagugggagcccagcaagggcuggaacgacuggcagcagguccccuucugcucccaccacuuccaccagcucaucaugaaggacgggcgcgagaucguggucccgugccggaaccaggacgagcuggugggccgcgcccgggugagccagggggccggcuggagccugcgcgagaccgccugccucgggaaguccuacgcgcagauguggcagcugauguacuuccaccggcgcgaccugcggcucgccgccaacgccaucugcagcgccguccccgugaacugggugcccaccucccgcaccaccuggagcauccacgcgcaccaccaguggaugacgaccgaggacaugcuguccgucuggaaccgcguguggaucgaggagaaccccuggauggaggacaagacccacgugagcuccugggaggacgucccguaccugggcaagcgggaggaccaguggugcggcagccucaucgggcugaccgcccgcgccacgugggccaccaacauccagguggcgaucaaccaggugcggcgccugaucggcaacgagaacuaccucgacuacaugaccuccaugaagcgguucaagaacgagagcgaccccgagggggcccugugguga

SEQ ID NO: 7953 - RNA, 9879 nt, Artificial Sequence
  derived and/or modified CDS sequence (opt1) from DENV-1__KX380797__SS-prME
agcgugaccgugcugcucaugcugcugcccaccgcccucgccuuccaccugaccacccgcggcggggagccccacaugaucgugagcaagcaggagcggggcaagagccugcuguucaagaccuccaccggggugaacaugugcacccugaucgcgauggaccugggcgagcucugcgaggacaccaugaccuacaagugcccccgcaucaccgagaccgagcccgacgacguggacugcuggugcaacgccaccgagaccugggugaccuacgggaccugcagccagaccggcgagcaccggcgcgacaagcgguccguggcccuggcgccccacgucggccuggggcucgagacccgcaccgagaccuggaugagcuccgagggcgccuggcggcagauccagaagguggagaccugggcccugcgccaccccggguucaccgugaucgcccuguuccucgcccacgccaucggcaccagcaucacgcagaaggggaucaucuucauccugcugaugcucgucacccccuccauggcgaugcggugcgugggcaucggcaaccgcgacuucguggaggggcugagcggcgccaccugggucgacguggugcuggagcacggguccugcgucaccacgauggccaaggacaagcccacccucgacaucgagcugcugaagaccgaggugaccaaccccgccgugcuccggaagcugugcaucgaggccaagaucagcaacacgaccaccgacucccgcugccccacccagggcgaggcgacgcuggucgaggagcaggacaccaacuucgugugccggcgcacccucguggaccggggcugggggaacggcugcgggcuguucggcaaggggagccugaucacgugcgccaaguucaagugcgucacgaagcucgagggcaagaucgugcaguacgagaaccugaaguacuccgugaucgucaccgugcacaccggcgaccagcaccaggucgggaacgagaccaccgagcacggcacgaccgccaccaucacgccccaggcccccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggcgagcaccagccaggagaccuggaaccggcaggaccuccuggucacguucaagaccgcccacgccaagaagcaggagguggugguccugggcucccaggagggcgccaugcacaccgcccucaccggggcgacggagauccagaccagcggcaccaccacgaucuucgccgggcaccugaagugccgccugaagauggacaagcucacccugaagggcguguccuacgugaugugcaccgggagcuucaagcuggagaaggaggucgccgagacccagcacggcacggugcuggugcaggucaaguacgagggcaccgacgcccccugcaagauccccuucaccucccaggacgagaagggggugacccagaacggccggcucaucacggccaacccgaucgugaccgacaaggagaagcccgucaacaucgaggcggagccgcccuucggggagagcuaccugguggugggcgccggcgagaaggcccugaagcucuccugguucaagaaggggagcuccaucggcaagauguucgaggccaccgcgcgcggggcccggcgcauggccauccugggcgacaccgccugggacuucgggagcaucggcggcgucuucacguccguggggaagcugauccaccagaucuucggcaccgccuacgggguccucuucagcggcgucuccuggaccaugaagaucgggaucggcauccugcugaccuggcucggccugaacagccgcuccacgagccuguccaugaccugcaucgcgguggggauggugacccucuaccugggcgucauggugcaggccgacagcgggugcgugaucaacuggaagggccgggagcugaagugcggguccggcaucuucgucaccaacgaggugcacaccuggacggagcaguacaaguuccaggccgacagcccgaagcgccucagcgccgccaucggcaaggcgugggaggagggggugugcggcauccgguccgccacccgccuggagaacaucauguggaagcagaucagcaacgagcugaaccacauccuccuggagaacgacaugaaguucaccgucguggugggggacgucaacggcauccuggcccaggggaagaagaugauccggccccagcccauggagcacaaguacuccuggaaguccuggggcaaggccaaggugaucggcgccgacgugcagaacuccaccuucaucaucgacgggcccaacacgccggagugccccgacgaccagcgcgcguggaacaucugggaggucgaggacuacggcuucgggaucuucaccaccaacaucuggcucaagcugcgggacagcuacacccaggugugcgaccaccgccugauguccgccgccaucaaggacagcaaggccgugcacgcggacaugggcuacuggaucgaguccgagaagaacgagacguggaagcucacccgggccagcuucaucgaggucaagaccugcguguggcccaagucccacacccuguggagcaacggcgugcuggaguccgagaugaucauccccaagaucuacgggggcccgaucagccagcacaacuaccgccccggguacuucacgcagaccgccggccccuggcaccucgggaagcuggagcuggacuucggccucugcgagggcaccaccgucgugguggacgagcacugcgggaaccggggcccgucccugcgcacgaccaccgucaccgggaagaucauccacgaguggugcugccggagcugcacgcugccgccccuccgcuucaagggcgaggacgggugcugguacggcauggagauccggcccgugaaggagaaggaggagaaccuggugaaguccauggucagcgccggcagcggggagguggacuccuucagccugggccuccugugcaucuccaucaugaucgaggaggugaugcgcagccgguggucccgcaagaugcugaugaccgggacccucgccgucuuccugcugcucaucaugggccagcugaccuggaacgaccugauccggcucugcaucauggugggggcgaacgccagcgacaagaugggcaugggcacgaccuaccuggcccugauggccaccuuccgcaugcgcccgauguucgccgucgggcuccuguuccggcgccugaccucccgggaggugcuccugcgcagcgugggccugucccucgucgcgagcguggagcugcccaacucccuggaggagcucggggacggccuggccaugggcaucaugaugcugaagcuccugacggacuuccagagccaccagcugugggccgcccuccugucccugaccuucgugaagaccaccuucagccuccacuacgccuggaagacgauggcgaugauccuguccaucgucagccuguucccccucugccuguccaccaccagccagaagaccacguggcugcccgugcuccuggggucccugggcugcaagccgcucaccauguuccugaucaccgagaacaagaucugggggcgcaagagcuggccccugaacgagggcaucauggccguggggaucgucagcauccuccuguccagccugcucaagaacgacgugccccuggccggcccccugaucgccggcgggaugcucaucgcgugcuacgugaucuccggcagcuccgccgaccugagccuggagaaggccgccgaggucuccugggaggaggaggccgagcacagcggggcgucccacaacauccucguggaggugcaggacgacggcaccaugaagaucaaggacgaggagcgcgacgacacccugacgauccugcucaaggccacccugcuggccaucagcggggucuacccgauguccauccccgccacccucuucgugugguacuucuggcagaagaagaagcagcggagcggcgugcugugggacacccccagcccgcccgaggucgagcgcgccgugcuggacgacggcaucuaccggauccugcagcgcgggcuccugggcaagagccaggugggggucggcguguuccaggaggggguguuccacacgauguggcacgucacccggggcgcggugcugauguaccagggcaagcgccucgagcccuccugggccagcgugaagaaggaccugaucuccuacgggggcggguggcgguuccagggcagcuggaacaccggggaggagguccaggugaucgccguggagcccggcaagaaccccaagaacguccagaccgcccccggcacguucaagacccccgagggggaggugggcgccaucgcgcuggacuucaagcccgggaccuccggcagccccaucgugaaccgcgagggcaagaucgucgggcucuacggcaacgggguggugaccacgagcggcaccuacgucuccgccaucgcccaggccaaggccagccaggaggggccgcugcccgagaucgaggacgagguguuccggaagcgcaaccugaccaucauggaccuccaccccggcuccggcaagacccggcgcuaccugccggcgaucgugcgggaggccaucaagcgcaagcugcggacgcucguccuggcccccacccgcgugguggccagcgagauggcggaggcccugaaggggaugcccauccgcuaccagaccaccgccgucaaguccgagcacacgggcaaggagaucguggaccucaugugccacgccaccuucaccaugcggcugcugagccccgugcgcgucccgaacuacaacaugaucaucauggacgaggcccacuucaccgaccccgcguccaucgccgcccggggguacaucagcacgcgcgugggcaugggggaggccgccgcgaucuucaugaccgccacgccgcccggcuccauggaggccuucccgcagagcaacgccgccauccaggacgaggagcgggacauccccgagcgcuccuggaacagcggcuacgacuggaucaccgacuuccccgggaagacggugugguucguccccuccaucaagagcggcaacgacaucgcgaacugccuccggaagaacgggaagcgcguggugcagcugucccggaagaccuucgacaccgaguaccagaagaccaagaacaacgacugggacuacgucgugacgaccgacaucagcgagaugggcgccaacuuccgcgccgaccgggucaucgacccgcgccggugccugaagcccgugauccucaaggacgggcccgagcgcgugauccuggccggccccaugccggucaccguggcguccgccgcccagcggcgcggccggaucgggcgcaaccagaacaaggagggcgaccaguacaucuacauggggcagccccugaacaacgacgaggaccacgcccacuggaccgaggccaagaugcuccuggacaacaucaacacgcccgagggcaucauccccgcgcuguucgagccggagcgggagaaguccgccgccaucgacggggaguaccgccuccgcggcgaggcccggaagaccuucguggagcugaugcgccggggcgaccugcccgucuggcucuccuacaagguggccagcgagggguuccaguacagcgaccgccgguggugcuucgacggcgagcgcaacaaccaggugcuggaggagaacauggacgucgagaucuggaccaaggagggggagcggaagaagcugcgcccccgguggcucgacgcgcgcaccuacuccgacccccuggcccugcgggaguucaaggaguucgccgccggccgccggagcguguccggcgaccucauccuggagaucgggaagcugccgcagcaccucacgcagcgcgcccagaacgcgcuggacaaccuggugaugcuccacaacagcgagcagggcgggaaggccuaccggcacgccauggaggagcugcccgacaccaucgagacccugaugcuccuggcccugaucgcgguccucaccggcggggugacccuguucuuccuguccggccgcggccucgggaagacgagcaucggccugcugugcgugauggccuccagcgcccuccuguggauggccuccgucgagccccacuggaucgccgcgagcaucauccuggaguucuuccucauggugcugcugauccccgagccggaccggcagcgcacgccccaggacaaccagcucgccuacguggucaucgggcugcuguucaugauccucaccguggccgccaacgagaugggccugcuggagaccacgaagaaggaccucgggaucggccacguggccgcggagucccaccaccacgccgccaugcuggacgucgaccugcaccccgccagcgccuggacccucuacgcgguggccaccaccaucaucacgccgaugaugcggcacaccaucgagaacaccaccgccaacaucucccugacggccaucgccaaccaggcggccauccugaugggccucgacaagggguggcccaucagcaagauggacaucggcgugccccugcuggcccucgggugcuacucccaggucaacccccugacccugaccgccgcggugcucaugcugguggcccacuacgccaucaucggcccggggcugcaggccaaggccacccgcgaggcgcagaagcggacggccgccggcaucaugaagaaccccaccgucgacggcaucguggccaucgaccucgaccccguggucuacgacgccaaguucgagaagcagcuggggcagaucaugcugcucauccugugcaccagccagauccugcucaugcgcaccacgugggcgcugugcgaguccaucacccuggccaccggcccccucaccacgcugugggaggggagcccgggcaaguucuggaacaccaccaucgccguguccauggccaacaucuuccgcggcagcuaccuggccggggcgggccucgccuucagccugaugaagucccucgggggcgggcggcgcgggaccggcgcccagggggagacgcucggcgagaaguggaagcggcagcugaaccagcugaccaagagcgaguucaacaccuacaagcgcuccgggaucaucgagguggaccggagcgaggccaaggagggccucaagcgcggggagaccacgaagcacgcggucucccggggcaccgccaagcugcgcugguucguggagcggaaccuggugaagcccgagggcaaggucaucgaccuggggugcggccgcgggggcuggagcuacuacugcgccgggcucaagaaggugaccgaggugaagggcuacaccaagggcgggcccggccacgaggagcccaucccgauggccacguacggguggaaccuggucaagcuguacuccggcaaggacguguucuucacgccgcccgagaagugcgacacccuccugugcgacaucggggagagcucccccaacccgaccaucgaggagggccggacccugcgcgugcucaagauggucgagcccuggcugcggggcaaccaguucugcaucaaggugcugaaccccuacaugcccagcguggucgagacgcucgagcagaugcagcgcaagcacgggggcaugcuggugcggaacccgcugucccgcaacagcacccacgagauguacuggguguccugcgggaccggcaacaucgucagcgccgugaacaugaccucccggaugcuccugaaccgcuucacgauggcgcaccggaagcccaccuacgagcgcgacguggaccugggcgccgggacccgccacgucgccguggagcccgaggucgccaaccucgacaucaucggccagcggaucgagaacaucaagaacgagcacaagagcaccuggcacuacgacgaggacaaccccuacaagacgugggccuaccacggguccuacgaggugaagccgagcggcuccgcgagcagcauggugaacggggucgugcgccugcugaccaagcccugggacgugauccccauggucacccagaucgccaugaccgacacgacccccuucggccagcagcggguguucaaggagaagguggacacccgcaccccgaaggccaagcggggcacggcccagaucauggaggucaccgcccgcuggcucuggggguuccugucccggaacaagaagccccgcaucugcacccgggaggaguucacccgcaaggugcggagcaacgcggccaucggcgccguguucgucgacgagaaccaguggaacuccgccaaggaggcgguggaggacgagcgcuucugggaccuggugcaccgggagcgcgagcuccacaagcaggggaagugcgccacgugcgucuacaacaugaugggcaagcgggagaagaagcugggggaguucggcaaggccaagggcagccgcgccaucugguacauguggcugggggcccgguuccucgaguucgaggcgcugggcuucaugaacgaggaccacugguucucccgcgagaacagccuguccgggguggagggcgaggggcuccacaagcugggcuacauccugcgggacaucagcaagauccccggcgggaacauguacgccgacgacaccgccggcugggacacccgcaucaccgaggacgaccuccagaacgaggccaagaucacggacaucauggagccggagcacgcccugcuggcgaccuccaucuucaagcucaccuaccagaacaaggugguccgggugcagcgccccgccaagaacgggaccgugauggacgucaucagccgccgggaccagcgcggcuccggccagguggggacguacggccugaacaccuucaccaacauggaggcccagcugauccggcagauggagagcgaggggaucuuccuccccuccgagcuggagacccccaaccuggccgagcgcgugcucgacuggcuggagaaguacggcaucgagcggcugaagcgcauggccaucagcggggacgacugcgucgugaagccgguggacgaccgguucgcgacggcccucaccgcccugaacgacaugggcaagguccgcaaggacaucccccagugggagcccuccaagggcuggaacgacuggcagcagguccccuucugcagccaccacuuccaccagcugaucaugaaggacgggcgggagaucguggucccgugccgcaaccaggacgagcucgugggccgggcccgcgugucccagggggccggcuggagccugcgggagaccgcgugccugggcaagagcuacgcccagauguggcagcucauguacuuccaccgccgggaccugcgccuggccgccaacgcgaucugcuccgccguccccguggacugggugcccaccagccggacgaccugguccauccacgcccaccaccaguggaugaccaccgaggacaugcucagcgucuggaaccgcguguggaucgaggagaaccccuggauggaggacaagacccacguguccagcugggaggacgucccguaccugggcaagcgggaggaccaguggugcggcucccugaucgggcucacggcccgcgccaccugggcgaccaacauccagguggccaucaaccaggugcgccggcugaucggcaacgagaacuaccuggacuacaugaccagcaugaagcgcuucaagaacgaguccgaccccgagggggcccucugguga

SEQ ID NO: 7954 - RNA, 9879 nt, Artificial Sequence
  derived and/or modified CDS sequence (opt1) from DENV-1__KX380805__SS-prME
agcgugaccaugcugcucaugcugcugcccaccgcccucgccuuccaccugaccacccggggcggggagccccacaugaucgugagcaagcaggagcggggcaagagccuccuguucaagaccagcgcgggggugaacaugugcacccugaucgccauggaccugggcgagcucugcgaggacacgaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggcggcagauccagaagguggagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcgucuccuacgugaugugcaccgggagcuucaagcuggagaaggagguggcggagacccagcacggcacgguccugguccaggugaaguacgagggcaccgacgcccccugcaagauccccaucuccacccaggacgagaagggggucacccagaacggccggcucaucacggccaacccgaucgugaccgacaaggagaagcccgugaacaucgagaccgagccgcccuucggggagagcuacaucgucaucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccugacgcaggggaagaagaugauccggccccagcccauggagcacaaguacuccuggaaguccuggggcaaggcgaagaucaucggcgccgacacccagaacaccaccuucaucaucgacgggcccgacacgccggagugccccgacgaccagcgcgccuggaacaucugggaggucgaggacuacggcuucgggguguucaccaccaacaucuggcugaagcuccgggacuccuacacccagaugugcgaccaccgccugaugagcgccgcgaucaaggacuccaaggccgugcacgccgacaugggcuacuggaucgagagcgagaagaacgagacguggaagcuggcccgggccuccuucaucgaggucaagaccugcaucuggccccgcagccacacccucugguccaacggcgugcuggagagcgagaugaucauccccaagaucuacgggggcccgaucucccagcacaacuaccggcccggguacuucacccagacggcgggccccuggcaccuggggaagcucgagcuggacuucaaccugugcgagggcaccaccguggucguggacgagcacugcggcaaccgcgggccgagccuccggaccacgaccgugaccggcaagaucauccacgaguggugcugccgcuccugcacccugccgccccugcgguuccgcggggaggacggcugcugguacgggauggagauccggcccgucaaggagaaggaggagaaccucgugcgcagcaugguguccgccggcagcggcgaggucgacagcuucucccuggggcugcucagcguguccaucaugaucgaggaggugaugcggagccgcuggucccgcaagaugcugaugacgggcacccuggccgucuucuuccuccugaucauggggcagcugaccuggaacgaccucauccggcugugcaucauggugggcgccaacgugagcgaccgcauggggaugggcaccacguaccuggcccucauggcgaccuucaagaugcggccgauguucgccgucgggcugcuguuccgccggcucaccucccgcgaggugcugcugcucaccaucgggcugagccuggucgccuccguggagcuccccaacagccuggaggagcugggcgacgggcucgccaugggcaucaugaugcugaagcugcucacggacuuccagucccaccagcuguggaccacccugcucagccugaccuucaucaagacgacccugucccucgacuacgccuggaagaccauggcgauggugcugagcaucgucucccuguucccccucugccugagcaccacgucccagaagaccaccuggcugcccgugcuccugggcagcuucgggugcaagccgcugaccauguuccucaucaccgagaacaagaucuggggccggaaguccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagcgcgccgccgaggucagcugggaggaggaggccgagcacuccggcgcgagccacaacauccugguggaggugcaggacgacgggacgaugaagaucaaggacgaggagcgggacgacacccucaccauccugcugaaggccacccuccuggccgucuccggcguguacccgaugagcauccccgccacgcuguucgugugguacuucuggcagaagaagaagcagcgcuccgggguccucugggacacccccagcccgcccgagguggagcgggccgugcuggacgacggcaucuaccgcauccugcagcggggccugcucgggcgcucccaggucggcguggggguguuccaggacggcgucuuccacaccauguggcacgugacccgcggggcggugcugauguaccagggcaagcgccuggagcccagcugggccuccgucaagaaggaccucaucagcuacggcgggggcuggcgguuccagggguccuggaacacgggcgaggagguccaggugaucgccgucgagcccgggaagaaccccaagaacgugcagaccacccccggcaccuucaagacgcccgagggcgaggugggggccaucgcccuggacuucaagcccggcaccagcgggucccccaucgucaaccgcgagggcaagaucgugggccuguacgggaacggcguggucaccaccagcgggacguacgugagcgcgaucgcccaggccaaggccucccaggagggcccgcuccccgagaucgaggacgagguguucaagaagcggaaccugaccaucauggaccugcaccccgggagcggcaagacccgccgguaccucccggccaucguccgcgaggcgaucaagcgcaagcugcggacccugauccucgcccccacgcgcgugguggccuccgagauggccgaggcgcugaagggcaugcccauccgguaccagaccaccgccgucaagagcgagcacaccgggaaggagaucguggaccugaugugccacgccacguucaccaugcgccuccugucccccgugcgggucccgaacuacaacaugaucaucauggacgaggcccacuucaccgaccccgccagcaucgcggcccgcggcuacaucuccacccggguggggaugggcgaggccgccgccaucuucaugacggcgacgccgcccgggagcguggaggccuucccgcaguccaacgccgucauccaggacgaggagcgcgacauccccgagcggagcuggaacuccggcuacgacuggaucaccgacuuccccggcaagaccgugugguucgugcccagcaucaaguccgggaacgacaucgccaacugccugcgcaagaacggcaagcgggucauccagcucagccgcaagacguucgacaccgaguaccagaagaccaagaacaacgacugggacuacguggugaccacggacaucuccgagaugggggccaacuuccgggcggaccgcgucaucgacccgcggcgcugccugaagcccgugauccugaaggacggccccgagcgggucauccucgccgggcccaugccggugaccgccgccagcgcggcccagcgccggggccgcaucggccgcaaccagaacaaggagggggaccaguacaucuacaugggccagccccugaacaacgacgaggaccacgcccacuggaccgaggccaagaugcugcucgacaacaucaacacccccgaggggaucauccccgcccuguucgagccggagcgggagaaguccgcggccaucgacggcgaguaccgccugcgcggggaggcccgcaagacguucguggagcucaugcggcgcggcgaccugcccgucuggcugagcuacaagguggccuccgagggcuuccaguacagcgaccggcgcuggugcuucgacggggagcggaacaaccaggugcucgaggagaacauggacgucgagaucuggaccaaggagggcgagcgcaagaagcugcggccccgcuggcuggacgcccggaccuacagcgacccccucgcgcugcgcgaguucaaggaguucgccgccgggcggcgcuccgugagcggcgaccugauccucgagaucggcaagcugccgcagcaccugacccuccgggcccagaacgcccuggacaaccuggugaugcuccacaacuccgagcagggcgggaaggcguaccgccacgccauggaggagcugcccgacaccaucgagacgcugaugcuccuggcccugaucgccguccucaccgggggcgugacccuguucuuccugagcgggaagggccucggcaagaccuccaucgggcugcugugcgugauggcgagcuccguccuccuguggauggccagcguggagccccacuggaucgccgccuccaucauccuggaguucuuccucauggugcugcugauccccgagccggaccggcagcgcacgccccaggacaaccagcucgccuacgucgugaucggccugcuguucaugauccucaccguggcggccaacgagauggggcugcuggagaccaccaagaaggaccucggcaucgggcacgucguggccgagaaccaccaccacgccacgaugcuggacaucgaccugcaccccgccagcgcguggacccucuacgccguggccaccaccaucaucacgccgaugaugcggcacaccaucgagaacaccaccgccaacaucucccugacggccaucgcgaaccaggccgccauccugaugggccucgacaagggcuggcccaucagcaagauggacaucggggucccccugcuggcccucggcugcuacucccaggugaacccccugacccugaccgccgcggugcucaugcuggucgcccacuacgccaucaucgggccgggccugcaggccaaggcgacccgcgaggcccagaagcgcacggccgccgggaucaugaagaaccccaccguggacggcaucguggccaucgaccucgaccccgucguguacgacgcgaaguucgagaagcagcugggccagaucaugcugcucauccugugcaccagccagauccugcucaugcggaccacgugggcccugugcgaguccaucacccuggccaccgggccccucaccacgcugugggagggcagcccggggaaguucuggaacaccaccaucgccguguccauggccaacaucuuccgcggcagcuaccuggcgggcgccgggcucgccuucucccugaugaagucccugggcgggggccggcgcgggaccggcgcccagggcgagacgcucggggagaaguggaagcggcagcugaaccagcugagcaaguccgaguucaacaccuacaagcgcagcggcaucauggaggucgaccgguccgaggccaaggaggggcucaagcgcggcgagaccaccaagcacgcggugagccgggggacggccaagcugcgcugguucguggagcggaaccuggucaagcccgagggcaaggugaucgaccugggcugcgggcgcggcgggugguccuacuacugcgccggccucaagaaggugaccgaggucaagggguacaccaagggcggccccgggcacgaggagcccaucccgauggccaccuacggcuggaacaucgugaagcugcacagcgggcgggacguguucuucacgccgcccgagaagugcgacacgcugcucugcgacaucggcgaguccagccccaacccgaccaucgaggaggggcgcacccugcggguccugaagaugguggagcccuggcuccgcggcaaccaguucugcaucaagauccugaaccccuacaugcccuccguggucgagacccuggagcagaugcagcggaagcacggcgggaugcucgugcgcaacccgcugagccggaacuccacgcacgagauguacugggugagcugcggcaccgggaacaucgucuccgcggugaacaugaccagccgcaugcugcucaaccgcuucaccauggcccaccggaagcccacguacgagcgcgacguggaccugggcgccggcacccggcacgucgccguggagcccgagaucgccaaccuggacaucaucgggcagcgcaucgagaacaucaagaacgagcacaaguccaccuggcacuacgacgaggacaaccccuacaagaccugggcguaccacggcagcuacgaggugaagccguccgggagcgccuccagcauggucaacggcgugguccggcuccugacgaagcccugggacgugauccccauggugacccagaucgccaugaccgacaccacgcccuucgggcagcagcgcgucuucaaggagaagguggacacccggaccccgcgccccaagcggggcaccgcccagaucauggaggugacggccaaguggcuguggggcuuccucagccgcaacaagaagccccggaucugcacccgcgaggaguucacccggaagguccgcuccaacgcggccaucggggccguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggccaagggcucccgggccaucugguacauguggcugggcgcccgcuuccuggaguucgaggcgcucggguucaugaacgaggaccacugguucagccgggagaacucccugagcggcgucgagggggagggccugcacaagcucggguacauccugcgcgacaucuccaagaucccgggcggcaacauguacgccgacgacacggccgggugggacacccgcaucaccgaggacgaccugcagaacgaggccaagaucaccgacaucauggagcccgagcacgcccuccuggcgacgagcaucuucaagcugaccuaccagaacaagguggugcggguccagcgccccgccaaguccggcaccgugauggacgugaucagccggcgcgaccagcggggguccggccaggucggcaccuacgggcucaacacguucaccaacauggaggugcagcugauccgccagauggagagcgagggcaucuucucccccagcgagcuggagaacuccaaccucgccgagcgggugcuggacuggcuggagaagcacggggucgagcgccucaagcggauggccaucagcggcgacgacugcguggugaagccgaccgacgaccgcuucgccaccgcgcugacggcccugaacgacauggggaagguccggaaggacaucccccagugggagcccuccaagggcuggaacgacuggcagcagguccccuucugcagccaccacuuccaccagcucaucaugaaggacggccgcgagaucguggucccgugccggaaccaggacgagcugguggggcgcgcccgggugagccagggcgccggguggucccugcgcgagaccgccugccucggcaagagcuacgcgcagauguggcagcugauguacuuccaccggcgcgaccugcggcucgccgccaacgccaucugcuccgccguccccgugaacugggugcccaccagccgcaccaccugguccauccacgcgcaccaccaguggaugacgaccgaggacaugcugagcgucuggaaccgcguguggaucgaggagaaccccuggauggaggacaagacccacguguccagcugggaggacgucccguaccuggggaagcgggaggaccaguggugcggcucccucaucggccugaccgcccgcgccacgugggccaccaacauccagguggcgaucaaccaggugcggcgccugaucgggaacgagaacuaccucgacuacaugaccagcaugaagcgguucaagaacgaguccgaccccgagggcgcccugugguga

SEQ ID NO: 7955 - RNA, 9879 nt, Artificial Sequence
  derived and/or modified CDS sequence (opt1) from DENV-1__KX380798__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacacgaugaccuacaagugcccccggaucaccgaggccgagcccgacgacguggacugcuggugcaacgccaccgacacgugggugaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcguggggaagcugguccaccagaucuucggcaccgccuacgggguccucuucuccggcgugagcuggaccaugaagaucgggaucggcguccugcugacguggcucggccugaacucccgcagcaccucccugagcaugaccugcaucgccguggggcucgugacccuguaccugggcgucauggugcaggccgacuccgggugcgugaucaacuggaagggccgggagcucaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccuggagaacaucauguggaagcagaucuccaacgagcucaaccacauccugcuggagaacgacaugaaguucaccgucguggugggggacgucgcgggcauccucgcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcugcgggacagcuacacccaggucugcgaccaccgccucauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcuguggagcaacggcguccucgaguccgagaugaucauccccaagaucuacgggggcccgaucagccagcacaacuaccgccccggguacuucacccagaccgccggccccuggcaccuggggaagcuggagcucgacuucgaccugugcgagggcaccacggugguggucgacgagcacugcggcaaccgggggccgucccugcgcaccaccaccgugacgggcaagaucauccacgaguggugcugccggagcugcacccugccgccccuccgcuuccgcggggaggacggcugcugguacgggauggagauccgccccgugaaggagaaggaggagaaccuggucaaguccauggugagcgccggcagcggcgagguggacuccuucagccucgggcugcugugcaucuccaucaugaucgaggaggucaugcggagccgcuggucccggaagaugcucaugaccggcacccuggccguguuccugcuccugaucauggggcagcugacguggaacgaccucauccgccugugcaucauggugggcgcgaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggcguccgucgagcuccccaacagccuggaggagcugggcgacgggcucgccaugggcaucaugauccugaagcugcucaccgacuuccagucccaccagcugugggccacccugcucagccugacguucaucaagaccaccuucucccugcacuacgccuggaagaccauggcgauggugcucagcaucgucucccuguucccccugugccucagcacgaccucccagaagaccaccuggcugcccgugcugcucggcagccuggggugcaagccgcugacgauguuccucaucgccgagaacaagaucuggggccggcgcuccuggccccugaacgaggggaucauggccgugggcaucgucagcauccugcucagcucccugcugaagaacgacgugccccucgccgggccccugaucgccggcggcaugcugaucgcgugcuacgugaucagcggguccagcgccgaccucucccuggagaaggccgccgaggucagcugggaggaggaggccgagcacuccggcgcgagccacaacauccugguggaggugcaggacgacgggaccaugaagaucaaggacgaggagcgggacgacacccucaccauccugcugaaggccacccuccuggccgucuccggcguguacccgcugagcauccccgccacccucuucgugugguacuucuggcagaagaagaagcagcgcuccgggguccugugggacacccccagcccgcccgagguggagcgggccgugcuggacgacggcaucuaccgcaucaugcagcggggccugcucgggcgcucccaggucggcguggggguguuccaggagaacgucuuccacaccauguggcacgugacccggggcgcggugcugauguaccaggggaagcgccuggagcccagcugggccuccgucaagaaggaccucaucagcuacggcggcggguggcggcugcagggcuccuggaacacgggggaggagguccaggugaucgccgucgagcccggcaagaaccccaagaacgugcagaccgcccccgggaccuucaagacccccgagggcgaggugggcgccaucgcgcuggacuucaagcccgggacgagcggcucccccaucgucaaccgcgaggggaagaucgugggccucuacggcaacgggguggucaccaccagcggcaccuacgugagcgccaucgcccaggccaaggcgucccaggaggggccgcugcccgagaucgaggacgagguguuccggaagcgcaaccugacgaucauggaccuccaccccggcagcgggaagacccggcgcuaccugccggccaucguccgggaggccaucaagcgcaagcugcgcacccucauccuggcccccacccgggugguggccuccgagauggcggaggcccugaagggcaugcccauccgcuaccagacgaccgccgucaagagcgagcacaccggcaaggagaucguggaccucaugugccacgccaccuucacgaugcggcugcugucccccgugcgcgucccgaacuacaacaugaucaucauggacgaggcccacuucaccgaccccagcuccaucgcggcccggggguacaucagcacccgcgugggcaugggggaggccgccgccaucuucaugaccgcgacgccgcccggcuccguggaggccuucccgcagagcaacgccgucauccaggacgaggagcgggacauccccgagcgcuccuggaacagcggguacgaguggaucaccgacuuccccggcaagaccgugugguucgugcccuccaucaagagcggcaacgacaucgccaacugccuccggaagaacgggaagcgcgucauccagcugucccggaagaccuucgacacggaguaccagaagaccaagaacaacgacugggacuacguggugaccaccgacaucagcgagaugggcgcgaacuuccgcgccgaccgggucaucgacccgcgccggugccugaagcccgugauccucaaggacgggcccgagcgcgugauccuggccggccccaugccggucacgguggccuccgccgcgcagcggcgcgggcggaucggccgcaaccacaacaaggagggcgaccaguacaucuacauggggcagccccugaacaacgacgaggaccacgcccacuggaccgaggccaagaugcuccuggacaacaucaacacccccgagggcaucauccccgcccuguucgagccggagcgcgagaaguccgccgcgaucgacggggaguaccggcuccgcggcgaggcccggaagaccuucgucgagcugaugcgccgcggggaccugcccguguggcucuccuacaagguggccagcgagggcuuccaguacagcgaccgccgguggugcuucgacggcgagcgcaacaaccagguccuggaggagaacauggacguggagaucuggacgaaggagggggagcggaagaagcugcgcccccgguggcucgacgcccgcaccuacuccgacccccuggcccugcgggaguucaaggaguucgcggccggccgccggagcguguccggggaccucauccuggagaucggcaagcugccgcagcaccucacccagcgcgcccagaacgcccuggacaaccuggucaugcuccacaacagcgagcagggcgggcgggcguaccgccacgccauggaggagcugcccgacaccaucgagacgcugaugcuccuggcccugaucgccgugcucaccggcggggugacccuguucuuccuguccggccgggggcucggcaagaccagcaucggccugcugugcgucauggccuccagcgugcuccuguggauggcguccguggagccccacuggaucgccgccagcaucauccuggaguucuuccucaugguccugcugauccccgagccggaccgccagcggacgccccaggacaaccagcucgccuacguggugaucgggcugcuguucaugauccucacggucgccgcgaacgagaugggccugcuggagaccaccaagaaggaccucgggaucggccacguggccguggggaaccaccaccacgccgccaugcuggacgucgaccugcaccccgccuccgcguggacccucuacgccguggccacgaccaucaucaccccgaugaugcgccacaccaucgagaacacgaccgccaacaucagccugaccgccaucgcgaaccaggccgccauccugaugggccucgacaagggcuggcccaucuccaagauggacaucggggugccccugcuggcccucggcugcuacagccaggucaacccccugacccugacggcggccgugcucaugcugguggcccacuacgccaucaucgggccgggccugcaggccaaggcgacccgcgaggcccagaagcggaccgccgccgggaucaugaagaaccccaccgucgacggcaucguggccaucgaccucgaccccguggucuacgacgcgaaguucgagaagcagcugggccagaucaugcugcucauccugugcacgucccagauccugcucaugcgcaccaccugggcccugugcgagagcaucacccuggccacggggccccucaccacccugugggagggcuccccggggaaguucuggaacaccacgaucgccgugagcauggccaacaucuuccggggcuccuaccuggcgggcgccgggcucgccuucagccugaugaagucccugggcgggggccgccgggggaccggcgcccagggcgagacccucggggagaaguggaagcgccagcugaaccagcuguccaagagcgaguucaacaccuacaagcgguccggcaucauggagguggaccgcagcgaggcgaaggaggggcucaagcggggcgagacgaccaagcacgccgucucccgcgggaccgccaagcugcggugguucguggagcgcaaccuggugaagcccgagggcaaggucaucgaccugggcugcgggcggggcggguggagcuacuacugcgccggccucaagaaggugaccgaggugaagggguacacgaagggcggccccgggcacgaggagcccaucccgauggccaccuacggcuggaaccuggucaagcugcacuccgggaaggacguguucuucaucccgcccgagaagugcgacacccuccugugcgacaucggcgagagcucccccaacccgaccaucgaggaggggcgcacgcugcgggugcucaagauggucgagcccuggcugcgcggcaaccaguucugcaucaagauccugaaccccuacaugcccagcgugguggagacccucgagcagaugcagcggaagcacggcgggaugcugguccgcaacccgcugucccggaacagcacccacgagauguacuggguguccugcggcaccgggaacaucgugagcgcggucaacaugaccucccgcaugcuccugaaccgcuucacgauggcccaccggaagcccaccuacgagcgcgacguggaccugggcgccggcacccggcacguggccgucgagcccgagguggccaaccucgacaucaucgggcagcgcaucgagaacaucaagcacgagcacaagagcaccuggcacuacgacgaggacaaccccuacaagacgugggcguaccacggcuccuacgaggugaagccgagcggguccgccagcagcauggucaacggcguggucaagcugcugaccaagcccugggacgugauccccauggugacccagaucgccaugaccgacacgacccccuucgggcagcagcgggucuucaaggagaagguggacacccgcaccccgaaggccaagcggggcacggcccagaucauggaggugaccgcgaaguggcucuggggcuuccugucccgcaacaagaagccccggaucugcacccgcgaggaguucacccggaagguccgcagcaacgccgccaucggggccguguucguggacgagaaccaguggaacuccgcgaaggaggccgucgaggacgagcgguucugggaccuggugcacaaggagcgcgagcuccacaagcagggcaagugcgccacgugcguguacaacaugauggggaagcgggagaagaagcugggcgaguucgggaaggccaagggcagccgcgccaucugguacauguggcugggcgcgcgguuccucgaguucgaggcccugggguucaugaacgaggaccacugguucucccgcgagaacagccuguccggcgucgagggggagggccuccacaagcugggguacauccugcgggacaucagcaagauccccggcggcaacauguacgccgacgacaccgccgggugggacacccgcaucaccgaggacgaccuccagaacgaggcccggaucacggacaucauggagccggagcacgcgcugcuggccaaguccaucuucaagcucaccuaccagaacaagguggugcgcguccagcgccccgccaagaacggcaccgugauggacgugaucagccggcgcgaccagcggggguccggccaggucggcaccuacgggcugaacacguucaccaacauggaggcccagcugauccgccagauggagagcgagggcaucuucucccccagcgagcucgagacccccaaccuggccgagcgggugcuggacuggcucgagaaguacgggguggagcgccugaagcggauggcgaucuccggcgacgacugcgucgugaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcccgggugagccagggcgcgggguggagccuccgcgagaccgccugccugggcaaguccuacgcccagauguggcagcugauguacuuccaccggcgcgaccuccggcuggccgcgaacgccaucugcagcgccgugcccgucgacuggauccccaccucccgcaccacguggagcauccacgcccaccaccaguggaugaccaccgaggacaugcuguccguguggaaccggguguggaucgaggagaaccccuggauggaggacaagacccacaucagcuccuggggcgacgucccguaccucggcaagcgcgaggaccaguggugcggcagccugaucgggcugacggcccgcgcgaccugggccaccaacauccagguggccaucaaccaggugcggcgccucaucggcaacgagaacuaccuggacuacaugaccuccaugaagcgguucaagaacgagagcgaccccgagggggcccugugguga

SEQ ID NO: 7956 - RNA, 9879 nt, Artificial Sequence
  derived and/or modified CDS sequence (opt1) from DENV-1__KJ649286__SS-prME
agcgugaccaugcugcucaugcugcugcccaccgugcucgccuuccaccugaccacccgcggcggggagccccacaugaucgugaccaagcaggagcggggcaagagccugcuguucaagaccagcaccggggugaacaugugcacccugaucgccauggaccugggcgagcucugcgaggacaccaugaccuacaagugcccccgcaucaccgaggcggagcccgacgacaucgacugcuggugcaacgccaccgacaccugggugaccuacgggaccugcucccagaccggcgagcaccggcgcgacaagcggagcguggcccuggcgccccacgugggccuggggcucgagacccgcaccgagacguggauguccagcgagggcgccuggaagcagauccagcgggucgagaccugggcgcugcgccaccccggguucaccgugaccgcccuguuccucgcccacgccaucggcacguccaucacccagaaggggaucaucuucauccugcugaugcucgugacccccagcauggcgaugcggugcgucggcaucggcaaccgcgacuucguggaggggcuguccggcgccaccuggguggacgucgugcuggagcacgggagcugcgugacgaccauggccaaggacaagcccacccucgacaucgagcugcugaagaccgaggucacgaaccccgccgugcuccggaagcugugcaucgaggccaagaucuccaacaccaccaccgacagccgcugcccgacgcagggcgaggcgacccugguggaggagcaggacgccaacuucgucugccggcgcaccuucguggaccggggcugggggaacggcugcggccuguucggcaaggggucccugaucacgugcgccaaguucaagugcgugacgaagcuggagggcaagaucguccaguacgagaaccucaaguacagcgugaucgugaccguccacaccggcgaccagcaccagguggggaacgaguccaccgagcacggcaccacggccaccaucacgccccaggcccccaccagcgagauccagcugacggacuacggggcgcugacccucgacugcagcccccggaccggccuggacuucaacgagaugguccugcucaccaugaaggagaaguccuggcuggugcacaagcagugguuccuggaccucccgcugcccuggacguccggggccaccaccagccaggagaccuggaaccggcaggaccugcucgugacguucaagaccgcccacgccaagaagcaggaggucguggugcugggcagccaggagggcgccaugcacaccgcgcugaccggggccacggagauccagaccuccggcaccaccacgaucuucgccgggcaccucaagugccgccugaagauggacaagcugacccucaagggcaugagcuacgucaugugcaccggguccuucaagcuggagaaggaggugguggagacccagcacggcacgguccugguccaggugaaguacgagggcaccgacgcccccugcaagauccccuuccugacccaggacgagaagggggucacccagaacggccgggugaucacggccaacccgaucgugaccgacaaggagaagcccgucaacaucgaggcggagccgcccuucggggagagcuacaucguggugggcgccggcgagaaggcccucaagcuguccugguucaagaaggggagcaccaucggcaagauguucgaggccaccgcgcgcggggcccggcgcauggccauccugggcgacacggccugggacuucggguccaucggcggcgucuucaccagcguggggaagcucgugcaccagaucuucggcaccgccuacgggguccuguucuccggcgugagcuggaccaugaagaucgggaucggcgugcugcucacguggcugggccugaacucccgcagcaccucccucagcaugaccugcaucgcggucgggcuggugacccuguaccucggcgugaugguccaggccgacuccgggugcgugaucaacuggaagggccgggagcugaagugcgggagcggcaucuucgugaccaacgagguccacacguggaccgagcaguacaaguuccaggccgacuccccgaagcgccugagcgccgccaucggcaaggcgugggaggagggggugugcggcauccgguccgccacccgccucgagaacaucauguggaagcagaucagcaacgagcugaaccacauccugcucgagaacgacaugaaguucaccguggucgugggggacgugagcggcauccuggcccaggggaagaagaugauccggccccagcccauggagcacaaguacuccuggaaguccuggggcaaggccaagaucaucggcgccgacguccagaacuccacguucaucaucgacgggcccaacaccccggagugccccgacgaccagcgcgcguggaacaucugggagguggaggacuacggcuucgggaucuucaccaccaacaucuggcugaagcuccgggacagcuacacccaggugugcgaccaccgccugauguccgccgccaucaaggacagcaaggccguccacgcggacaugggcuacuggaucgaguccgagaagaacgagaccuggaagcuggcccgggccagcuucaucgaggugaagaccugcguguggcccaagucccacacccucuggagcaacggcguccuggaguccgagaugaucauccccaagaucuacgggggcccgaucagccagcacaacuaccgccccggguacuucacgcagaccgccggccccuggcaccuggggaagcucgagcuggacuucgaccugugcgagggcaccaccgugguggucgacgagcacugcggcaaccgggggccgucccuccgcacgaccaccgugaccggcaagaucauccacgaguggugcugccggagcugcacgcugccgccccugcgcuucaagggggaggacggcugcugguacgggauggagauccggcccgugaaggagaaggaggagaaccucgucaaguccauggugagcgccggcuccggcgagguggacagcuucagccuggggcugcucugcaucuccaucaugaucgaggaggucaugcgcagccgguggucccgcaagaugcugaugaccggcacccuggcgguguuccuccugcugaucauggggcagcucaccuggaacgaccugauccggcugugcaucauggucggcgccaacgccagcgaccgcauggggaugggcacgacguaccucgcccugauggccaccuucaagaugcgcccgauguucgccguggggcuccucuuccggcgccugaccucccgggaggugcugcuccugacgaucgggcugagccucgucgccuccguggagcugcccaacagccuggaggagcucggcgacgggcuggccaugggcaucaugauccugaagcuccugaccgacuuccagucccaccagcugugggccgcccuccugagccugaccuucaucaagaccacgugcucccuccacuacgcguggaagaccauggccauggugcugagcaucgucucccuguucccccucugcaugagcaccaccucccagaagacgaccuggcugcccgugcugcucggcagccuggggugcaagccgcugaccauguuccucaucgccgagaacaagaucuggggccgcaaguccuggccccugaacgaggggaucauggccgugggcaucgucagcauccugcucuccagccugcugaagaacgacgugccccucgcggggccccugguggccggcggcaugcugaucgccugcuacgucaucagcggguccagcgccgaccucucccuggagaaggccgcggaggugagcugggaggaggaggccgagcacuccggcgccagccacaacauccugguggagguccaggacgacgggaccaugaagaucaaggacgaggagcgggacgacacccucacgauccugcugaaggccacccuccuggccguguccggcguguacccgcugagcauccccgcgacccucuucgucugguacuucuggcagaagaagaagcagcgcuccggggugcugugggacacccccagcccgcccgagguggagcgggccguccuggacgacggcaucuaccgcaucaugcagcggggccugcucgggcgcucccaggugggcgugggggucuuccaggagaacguguuccacacgauguggcacgugacccggggcgccguccugauguacaaggggaagcgccuggagcccaccugggccagcgugaagaaggaccucaucuccuacggcggcggguggcggcugcagggcagcuggaacaccggggaggaggugcaggucaucgccguggagcccggcaagaaccccaagaacgugcagacggcgcccgggaccuucaagacccccgagggcgaggucggcgccaucgcccuggacuucaagcccgggaccuccggcagccccaucgugaaccgcgaggggaagaucgugggccucuacggcaacggggucgugacgaccuccggcaccuacgugagcgccaucgcccaggcgaaggccucccaggaggggccgcugcccgagaucgaggacgaggucuuccggaagcgcaaccugaccaucauggaccuccaccccggcagcgggaagacgcggcgcuaccugccggccaucgugcgggaggccaucaagcgcaagcugcggacccucauccuggcgcccacccgcguggucgccagcgagauggccgaggcccugaagggcaugcccauccgcuaccagaccacggccgugaaguccgagcacaccggcaaggagaucguggaccucaugugccacgcgaccuucaccaugcggcugcugagccccguccgcgugccgaacuacaacaugaucaucauggacgaggcccacuucacggaccccuccagcaucgccgcccggggguacaucuccacccgcgugggcaugggggaggccgcggccaucuucaugaccgccacgccgcccggcagcgucgaggccuucccgcaguccaacgccgugauccaggacgaggagcgggacauccccgagcgcagcuggaacuccggguacgacuggaucacggacuuccccggcaagaccgugugguucguccccagcaucaaguccggcaacgacaucgcgaacugccuccggaagaacgggaagcgcgugauccagcugagccggaagaccuucgacaccgaguaccagaagacgaagaacaacgacugggacuacgucgugaccaccgacaucuccgagaugggcgccaacuuccgcgccgaccgggugaucgacccgcgccggugccugaagcccgucauccucaaggacgggcccgagcgcgugauccuggccggccccaugccggugaccgucgcgagcgccgcccagcggcgcgggcggaucggccgcaaccagaacaaggagggcgaccaguacaucuacauggggcagccccugaacaacgacgaggaccacgcccacuggacggaggccaagaugcuccuggacaacaucaacacccccgagggcaucauccccgcgcuguucgagccggagcgggagaaguccgccgccaucgacggggaguaccgccuccgcggcgaggcccggaagaccuucguggagcugaugcgccgcggggaccugcccguguggcucagcuacaaggucgccuccgagggcuuccaguacagcgaccgccgguggugcuucgacggcgagcgcaacaaccaggugcuggaggagaacauggacguggagaucuggaccaaggagggggagcggaagaagcugcgcccccgguggcucgacgcgcgcacguacuccgacccccuggcccugcgggaguucaaggaguucgccgccggccgccggagcgucagcggggaccucauccuggagaucggcaagcugccgcagcaccucacccagcgcgcccaguccgcgcuggacaaccuggugaugcuccacaacagcgagcagggcgggcgggccuaccgccacgccauggaggagcugcccgacaccaucgagacccugaugcuccuggcccugaucgcggugcucaccggcggggucacgcuguucuuccuguccggcaaggggcucggcaagaccagcaucggccugcugugcgugauggccuccagcaugcuccuguggauggccuccguggagccccacuggaucgccgccagcaucauccuggaguucuuccucaugguccugcugauccccgagccggaccggcagcgcacgccccaggacaaccagcucgcguacguggugaucgggcugcuguucaugauccucaccgucgccgccaacgagaugggccugcuggagacgaccaagaaggaccucgggaucggccacguggccguggagaaccaccaccacgccaccaugcuggacgucgaccugcaccccgcguccgccuggacccucuacgccguggccacgaccaucaucaccccgaugaugcggcacaccaucgagaacacgaccgccaacaucagccugaccgcgaucgccaaccaggccgccauccugauggggcucgacaagggcuggcccaucuccaagauggacaucggcgugccccugcuggcccucgggugcuacagccaggucaaccccaugacccugacggcggccgugcugaugcucguggcccacuacaccaucaucggcccggggcugcaggccaaggcgacccgcgaggcccagaagcggaccgccgccggcaucaugaagaaccccacggucgacgggaucguggccaucgaccuggaccccguggucuacgacgcgaaguucgagaagcagcucggccagaucaugcugcugauccucugcaccucccagauccugcugaugcgcaccaccugggcccucugcgagagcaucacgcuggccaccggcccccugaccacccucugggagggguccccgggcaaguucuggaacacgaccaucgccgugagcauggccaacaucuuccgcggguccuaccuggcgggcgccggccuggccuucagccucaugaagucccucgggggcgggcggcgcgggaccggggcccagggcgagacccugggcgagaaguggaagcggcagcucaaccagcugagcaagagcgaguucaacacguacaagcgcuccgggaucaucgagguggaccggagcgaggccaaggagggccugaagcgcggggagaccaccaagcacgcggucucccggggcaccgccaagcuccgcugguucguggagcggaaccuggugaagcccgaggggaaggucaucgaccugggcugcggccgcgggggcuggagcuacuacugcgccgggcugaagaaggugacggaggugaagggcuacaccaagggcggggccggccacgaggagcccauccccauggcgaccuacggguggaaccucgucaagcugcacuccggcaaggacguguucuucaucccgcccgagaagugcgacacccugcucugcgacaucggggagagcucccccaaccccaccaucgaggagggccggacgcugcgcgugcugaagauggucgagccguggcuccgggggaaccaguucugcaucaagauccugaaccccuacaugcccagcgugguggagacccuggagcagaugcagcgcaagcacggcggcaugcucguccggaacccccugucccgcaacagcacccacgagauguacuggguguccugcgggaccggcaacaucgugagcgccgucaacaugacgucccggaugcugcucaaccgcuucaccauggcccaccggaagccgaccuacgagcgcgacguggaccugggggccggcacccgccacgucgccguggagcccgagguggcgaaccuggacaucaucggccagcggaucgagaacaucaagcacgagcacaagagcacguggcacuacgacgaggacaaccccuacaagaccugggccuaccacggguccuacgaggucaagcccagcggcuccgccagcuccauggugaacggggugguccgccuccugaccaagccgugggacgugauccccauggugacccagaucgccaugacggacaccacccccuucggccagcagcgggucuucaaggagaagguggacacccgcacgcccaaggccaagcgggggaccgcccaggugauggaggucaccgcccgcuggcuguggggcuuccucagccggaacaagaagccgcgcaucugcacccgggaggaguucacgcgcaaggugcggagcaacgccgccaucggcgccguguucgucgacgagaaccaguggaacuccgcgaaggaggccguggaggacgagcgcuucugggaccuggugcaccgggagcgcgagcugcacaagcaggggaagugcgcgaccugcgucuacaacaugaugggcaagcgggagaagaagcucggggaguucggcaaggccaaggggagccgcgcgaucugguacauguggcugggcgcccgguuccuggaguucgaggcccucggcuucaugaacgaggaccacugguucucccgcgagaacagccuguccgggguggagggcgaggggcugcaccggcucggcuacauccugcgcgacaucagcaagauccccgggggcaacauguacgccgacgacaccgccggcugggacacccggaucacggaggacgaccugcagaacgaggcgaagaucaccgacaucauggagcccgagcacgcccuccuggccaccuccaucuucaagcugaccuaccagaacaaggugguccgcgugcagcgcccggccaagaacgggacggugauggacgucaucagccggcgcgaccagcggggcuccggccaggugggcaccuacggccucaacaccuucaccaacauggaggcccagcugauccgccagauggagagcgaggggcuguucucccccagcgagcucgagacgcccaaccuggcggagcgggugcugaacuggcucggcaaguacggggucgagcgccugaagcggauggccaucuccggcgacgacugcguggugaagcccaucgacgaccgcuucgccaccgcccugaccgcccucaacgacauggggaagguccggaaggacaucccgcagugggagcccagcaagggcuggaacgacuggcagcagguccccuucugcucccaccacuuccaccagcugaucaugaaggacggccgcgagaucgugguccccugccggaaccaggacgagcugguggggcgcgcgcgggugagccagggcgccggguggucccuccgcgagaccgccugccugggcaagagcuacgcccagauguggcagcugauguacuuccaccggcgcgaccuccggcuggccgcgaacgccaucugcagcgccgucccgguggacugggugcccacgucccgcaccaccuggagcauccacgcccaccaccaguggaugaccaccgagaacaugcuguccgucuggaaccggguguggaucgaggagaaccccuggauggaggacaagacgcacgugagcuccugggaggacguccccuaccucgggaagcgcgaggaccaguggugcggcagccugaucggccugaccgcgcgcgccaccugggccaccaacauccagguggccaucaaccaggugcggaagcucaucgggaacgagaacuaccuggacuacaugacguccaugaagcgcuucaagaacgacagcgacccggagggcgcccugugguga

SEQ ID NO: 7957 - RNA, 9879 nt, Artificial Sequence
  derived and/or modified CDS sequence (opt1) from DENV-1__KF887994__SS-prME
agcgugaccaugcugcucaugcugaugcccaccgcccuggccuuccaccucaccacccggggcggggagccccacaugaucgugagcaagcaggagcggggcaagagccugcuguucaagaccagcgcgggggugaacaugugcacccucaucgccauggaccugggcgagcugugcgaggacaccaugaccuacaagugcccccggaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccaccccggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcgauccugcggaagcucugcaucgaggccaagaucuccaacaccaccacggacagccgcugcccgacccagggcgaggccacccugguggaggagcaggacgccaacuucgugugccggcgcaccuucgucgaccggggcugggggaacggcugcgggcuguucggcaaggggucccucaucacgugcgccaaguucaagugcgugaccaagcuggagggcaagaucgugcaguacgagaaccugaaguacagcgucaucgugaccgugcacaccggcgaccagcaccaggucgggaacgaguccacggagcacggcaccaccgcgaccaucacgccccaggcccccacgaccgagauccagcucaccgacuacggggcccugacccuggacugcagcccccgcacgggccucgacuucaacgagauggugcugcugaccaugaaggagaaguccuggcucguccacaagcagugguuccuggaccugccccuccccuggaccagcggggccagcaccucccaggagacguggaaccggcaggaccugcuggugaccuucaagaccgcccacgcgaagaagcaggagguggucgugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgugaugugcaccggguccuucaagcucgagaaggaggucgcggagacgcagcacggcaccgugcuggugcagaucaaguacgagggcaccgacgcccccugcaagauccccuucagcacccaggacgagaagggggucacgcagaacggccggcugaucaccgccaacccgaucgugaccgacaaggagaagcccgugaacaucgaggccgagccgcccuucggggaguccuacaucgucaucggcgcgggcgagaaggcccugaagcucagcugguucaagaagggguccagcaucggcaagaugcuggaggccaccgcccgcggggcccggcgcauggcgauccugggcgacacggccugggacuucggguccaucggcggcguguucaccagcguggggaagcucguccaccagaucuucggcaccgccuacggggugcuguucuccggcgugagcuggaccaugaagaucgggaucggcguccugcucacguggcugggccugaacucccgcagcaccucccucagcaugaccugcaucgccguggggcuggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacagcccgaagcgccuguccgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgucgcgggcauccuggcccaggggaagaagaugauccggccccagcccauggaguacaaguacagcuggaaguccuggggcaaggccaagaucaucggcgccgacgugcagaacacgaccuucaucaucgacgggcccaacaccccggagugccccgacgaccagcgcgcguggaacaucugggagguggaggacuacggcuucgggaucuucaccacgaacaucuggcugaagcuccgggacagcuacacccaggucugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcaucuggcccaagucccacacgcucuggagcaacggcguccuggaguccgagaugaucauccccaagaucuacgggggcccgaucagccagcacaacuaccgccccggguacuucacccagaccgccggccccuggcaccuggggaagcucgagcuggacuucgaccugugcgagggcaccacggugguggucgacgagcacugcggcaaccgggggccgucccuccgcaccaccaccgugacgggcaagaucauccacgaguggugcugccggagcugcacccugccgccccugcgcuuccgcggggaggacggcugcugguacgggauggagauccgccccgugaaggagaaggaggagaaccucgucaaguccauggugagcgccggcagcggcgagguggacuccuucagccuggggcugcucugcaucuccaucaugaucgaggaggucaugcggagccgcuggucccggaagaugcugaugaccggcacccuggccguguuccuccugcugaucaucgggcagcucacguggaacgaccugauccgccugugcaucauggugggcgcgaacgccagcgaccgcauggggaugggcaccaccuaccucgcccugauggccaccuucaagaugcggccgauguucgccgucgggcuccuguuccgccggcugacgucccgcgaggugcugcuccugaccaucgggcugagccucauggcguccguggagcugcccaacagccuggaggagcucggcgacgggcuggccaugggcaucaugauccugaagcuccugaccgacuuccagucccaccagcugugggccacccuccugagccugacguucaucaagaccaccuucucccuccacuacgccuggaagaccauggcgaugguccugagcaucgugucccuguucccccucugccugagcacgaccucccagaagaccaccuggcugcccguccuccugggcagccuggggugcaagccgcucacgauguuccugaucgccgagaacaagaucuggggccggcgcuccuggccccugaacgaggggaucauggccgugggcaucgugagcauccuccugagcucccugcucaagaacgacgucccccuggccgggccccugaucgccggcggcaugcucaucgcgugcuacgugaucagcggguccagcgccgaccugucccuggagaaggccgccgaggugagcugggaggaggaggccgagcacuccggcgcgagccacaacauccucgucgaggugcaggacgacgggaccaugaagaucaaggacgaggagcgggacgacacccugaccauccugcucaaggccacccugcuggccguguccggcgucuacccgcucagcauccccgccacgcuguucgugugguacuucuggcagaagaagaagcagcgcuccggggugcugugggacacccccagcccgcccgaggucgagcgggccgugcuggacgacggcaucuaccgcaucaugcagcggggccuccuggggcgcucccaggugggcgucgggguguuccaggagaacguguuccacaccauguggcacgucacccggggcgcggugcugauguaccaggggaagcgccucgagcccagcugggccuccgugaagaaggaccugaucagcuacggcggcggguggcggcugcagggcuccuggaacacgggggaggagguccaggugaucgccguggagcccggcaagaaccccaagaacguccagaccgcccccgggaccuucaagacccccgagggcgaggugggcgccaucgcgcucgacuucaagcccgggacgagcggcucccccaucgugaaccgcgaggggaagaucgucggccuguacggcaacgggguggugaccaccagcggcaccuacgucagcgccaucgcccaggccaaggcgucccaggaggggccgcugcccgagaucgaggacgagguguuccggaagcgcaaccucacgaucauggaccugcaccccggcagcgggaagacccggcgcuaccugccggccaucgugcgggaggccaucaagcgcaagcuccgcacccugauccuggcccccacccgggucguggccuccgagauggcggaggcccucaagggcaugcccauccgcuaccagacgaccgccgucaagagcgagcacaccggcaaggagaucgucgaccugaugugccacgccaccuucacgaugcggcugcucucccccgugcgcgugccgaacuacaacaugaucaucauggacgaggcccacuucaccgaccccagcuccaucgcggcccggggguacaucagcacccgcgucggcaugggggaggccgccgccaucuucaugaccgcgacgccgcccggcuccguggaggccuucccgcagagcaacgccgugauccaggacgaggagcgggacauccccgagcgcuccuggaacagcggguacgaguggaucaccgacuuccccggcaagaccgucugguucgugcccuccaucaagagcggcaacgacaucgccaacugccugcggaagaacgggaagcgcgugauccagcugucccggaagaccuucgacacggaguaccagaagaccaagaacaacgacugggacuacgucgugaccaccgacaucagcgagaugggcgcgaacuuccgcgccgaccgggugaucgacccgcgccggugccucaagcccgucauccugaaggacgggcccgagcgcgugauccuggccggccccaugccggugacggucgccuccgccgcgcagcggcgcgggcggaucggccgcaaccacaacaaggagggcgaccaguacaucuacauggggcagccccucaacaacgacgaggaccacgcccacuggaccgaggccaagaugcugcuggacaacaucaacacccccgagggcaucauccccgcccucuucgagccggagcgcgagaaguccgccgcgaucgacggggaguaccggcugcgcggcgaggcccggaagaccuucguggagcugaugcgccgcggggaccuccccgucuggcuguccuacaagguggccagcgagggcuuccaguacagcgaccgccgguggugcuucgacggcgagcgcaacaaccaggugcuggaggagaacauggacgucgagaucuggacgaaggagggggagcggaagaagcuccgcccccgguggcuggacgcccgcaccuacuccgacccccuggcccuccgggaguucaaggaguucgcggccggccgccggagcguguccggggaccugauccuggagaucggcaagcucccgcagcaccugacccagcgcgcccagaacgcccuggacaaccucgugaugcugcacaacagcgagcagggcgggcgggcguaccgccacgccauggaggagcugcccgacaccaucgagacgcucaugcugcuggcccucaucgccguccugaccggcggggugacccuguucuuccucuccggccgggggcugggcaagaccagcaucggccugcucugcgugauggccuccagcguccugcuguggauggcguccguggagccccacuggaucgccgccagcaucauccucgaguucuuccugauggugcugcucauccccgagccggaccgccagcggacgccccaggacaaccagcuggccuacgucgugaucgggcuccuguucaugauccugacgguggccgcgaacgagaugggccugcucgagaccaccaagaaggaccuggggaucggccacgucgccguggggaaccaccaccacgccgccaugcuggacguggaccuccaccccgccuccgcguggacccuguacgccgucgccacgaccaucaucaccccgaugaugcgccacaccaucgagaacacgaccgccaacaucagccugaccgccaucgcgaaccaggccgccauccucaugggccuggacaagggcuggcccaucuccaagauggacaucggggugccccugcucgcccugggcugcuacagccaggugaacccccugacccucacggcggccguccugaugcugguggcccacuacgccaucaucgggccgggccuccaggccaaggcgacccgcgaggcccagaagcggaccgccgccgggaucaugaagaaccccaccguggacggcaucgucgccaucgaccuggaccccgugguguacgacgcgaaguucgagaagcagcugggccagaucaugcuccugauccugugcacgucccagauccuccugaugcgcaccaccugggcccugugcgagagcaucacccucgccacggggccccugaccacccugugggagggcuccccggggaaguucuggaacaccacgaucgccgucagcauggccaacaucuuccggggcuccuaccucgcgggcgccgggcuggccuucagccugaugaagucccucggcgggggccgccgggggaccggcgcccagggcgagacccugggggagaaguggaagcgccagcugaaccagcucuccaagagcgaguucaacaccuacaagcgguccggcaucauggagguggaccgcagcgaggcgaaggaggggcugaagcggggcgagacgaccaagcacgccgugucccgcgggaccgccaagcugcggugguucgucgagcgcaaccuggugaagcccgagggcaaggugaucgaccucggcugcgggcggggcggguggagcuacuacugcgccggccugaagaaggucaccgaggugaagggguacacgaagggcggccccgggcacgaggagcccaucccgauggccaccuacggcuggaaccuggugaagcuccacuccgggaaggacgucuucuucaucccgcccgagaagugcgacacccugcugugcgacaucggcgagagcucccccaacccgaccaucgaggaggggcgcacgcuccgggugcugaagaugguggagcccuggcugcgcggcaaccaguucugcaucaagauccucaaccccuacaugcccagcgucguggagacccuggagcagaugcagcggaagcacggcgggaugcuggugcgcaacccgcucucccggaacagcacccacgagauguacugggucuccugcggcaccgggaacaucgugagcgcggugaacaugaccucccgcaugcugcugaaccgcuucacgauggcccaccggaagcccaccuacgagcgcgacgucgaccucggcgccggcacccggcacguggccguggagcccgaggucgccaaccuggacaucaucgggcagcgcaucgagaacaucaagcacgagcacaagagcaccugguacuacgacgaggacaaccccuacaagacgugggcguaccacggcuccuacgaggugaagccgagcggguccgccagcagcauggugaacggcgucgugaagcugcucaccaagcccugggacgucauccccauggugacccagaucgccaugaccgacacgacccccuucgggcagcagcggguguucaaggagaaggucgacacccgcaccccgaaggccaagcggggcacggcccagaucauggaggugaccgcgaaguggcuguggggcuuccugucccgcaacaagaagccccggaucugcacccgcgaggaguucacccggaaggugcgcagcaacgccgccaucggggccgucuucguggacgagaaccaguggaacuccgcgaaggaggccguggaggacgagcgguucugggaccucguccacaaggagcgcgagcugcacaagcagggcaagugcgccacgugcguguacaacaugauggggaagcgggagaagaagcugggcgaguucgggaaggccaagggcagccgcgccaucugguacauguggcucggcgcgcgguuccuggaguucgaggcccugggguucaugaacgaggaccacugguucucccgcgagaacagcuucuccggcguggagggggagggccuccacaagcugggguacauccugcgggacaucagcaagauccccggcggcaacauguacgccgacgacaccgccgggugggacacccgcaucaccgaggacgaccuccagaacgaggcccggaucacggacaucauggagccggagcacgcgcugcuggccaaguccaucuucaagcucaccuaccagaacaaggucgugcgcgugcagcgccccgccaagaacggcaccgucauggacguggugagccggcgcgaccagcggggguccggccaggucggcaccuacgggcugaacacguucaccaacauggaggcccagcugauccgccagauggagagcgagggcaucuucucccccagcgagcucgagacccccaaccuggccgagcgggugcuggcguggcucgagaaguacgggguggagcgccugaagcggauggccaucuccggcgacgacugcgucgugaagccgaucgacgaccgcuucgccaccgcccugacggcccucaacgacauggggaaggugcggaaggacaucccccagugggagcccagcaagggcuggaacgacuggcagcagguccccuucugcucccaccacuuccaccagcugaucaugaaggacggccgcgagaucguggugccgugccggaaccaggacgagcuggucgggcgcgcgcgggugagccagggcgccggguggagccuccgcgagaccgccugccugggcaaguccuacgcccagauguggcagcugauguacuuccaccggcgcgaccuccggcuggcggccaacgccaucugcagcgccgugcccgucaacuggauccccaccucccgcaccacguggagcauccacgcccaccaccaguggaugaccaccgaggacaugcuguccguguggaaccggguguggaucgaggagaaccccuggauggaggacaagacccacaucagcuccuggggcgacgucccguaccucggcaagcgcgaggaccaguggugcggcagccugaucgggcugacggcgcgcgccaccugggccaccaacauccagguggccaucaaccaggugcggaagcucaucggcaacgagaacuaccuggacuacaugaccuccaugaagcgcuucaagaacgagagcgaccccgagggggcccugugguga

SEQ ID NO: 7958 - RNA, 9879 nt, Artificial Sequence
  derived and/or modified CDS sequence (opt1) from DENV-1__JQ675358__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccagaucaccgaggccgagcccgacgacguggacugcuggugcaacgccaccgacacgugggugaccuacgggaccugcagccagaccggcgagcaccggcgggacaagcgcuccguggcccuggcgccccacgugggccuggggcucgagacgcggaccgagaccuggaugagcuccgagggcgccuggaagcagauccagcgcgucgagaccugggcccugcggcaccccggguucacggugaucgcccuguuccucgcgcacgccaucggcaccagcaucacccagaaggggaucaucuucauccugcugaugcucgugacccccuccauggccaugcggugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcgauccuccgcaagcugugcaucgaggccaagaucagcaacaccaccacggacucccggugcccgacccagggcgaggccacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccgugcacaccggcgaccagcaccaggucgggaacgagacgaccgagcacggcaccaucgcgaccaucacgccccaggcccccacgagcgagauccagcugaccgacuacggggcccucacccuggacugcagcccccggaccggccuggacuucaacgagauggugcuccugacgaugaaggagcgcagcuggcugguccacaagcagugguuccucgaccugccgcugcccuggaccuccggggccagcaccagccaggagaccuggaaccggcaggaccuccuggugacguucaagaccgcccacgcgaagaagcaggagguggucgugcugggcucccaggagggcgccaugcacaccgcccucaccggggccacggagauccagaccagcggcaccaccacgaucuucgccgggcaccugaagugccgccugaagauggacaagcucacccugaagggcaccuccuacgugaugugcaccgggagcuucaagcuggagaaggaggucgcggagacgcagcacggcaccgugcuggugcaggucaaguacgagggcaccgacgcccccugcaagauccccuucuccacccaggacgagaagggggugacgcagaacggccggcucaucaccgccaacccgaucgugaccgacaaggagaagcccgucaacaucgagaccgagccgcccuucggggagagcuacaucguggugggcgccggcgagaaggcgcugaagcuguccugguucaagaaggggagcuccaucggcaagauguucgaggccacggcccgcggggcccggcgcauggccauccucggcgacaccgcgugggacuucgggagcaucggcggcgucuucaccuccguggggaagcuggugcaccaggucuucggcaccgccuacggggugcuguucagcggcguguccuggacgaugaagaucgggaucggcauccuccugaccuggcugggccucaacagccgcuccaccagccuguccaugaccugcaucgccgucgggauggugacgcuguaccucggcgugaugguccaggccgacagcgggugcgugaucaacuggaagggccgggagcugaagugcggguccggcaucuucgugaccaacgagguccacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucacgguggucgugggggacgccaacggcauccuggcgcaggggaagaagaugauccggccccagcccauggagcacaaguacuccuggaaguccuggggcaaggccaagaucaucggcgccgacauccagaacaccaccuucaucaucgacgggcccgacaccccggagugccccgacaaccagcgcgccuggaacaucugggagguggaggacuacggcuucgggaucuucacgaccaacaucuggcugaagcuccgggacuccuacacccagaugugcgaccaccgccugaugagcgcggccaucaaggacuccaaggccguccacgccgacaugggcuacuggaucgagagcgagaagaacgagaccuggaagcuggcccgggcguccuucaucgaggugaagacgugcaccuggcccaagagccacacccucugguccaacggcgugcuggagagcgagaugaucauccccaagaccuacgggggcccgaucucccagcacaacuaccgccccggguacuucacgcagaccgccggccccuggcaccuggggaagcucgagcuggacuucgaccugugcgagggcaccaccgucgugguggacgagcacugcggcaaccgggggccgagccuccgcacgaccaccgucaccggcaagaucauccacgaguggugcugccgguccugcacgcugccgccccugcgcuuccgcggggaggacggcugcugguacgggauggagauccgccccgugaaggagaaggaggagaaccucgugcggagcauggucuccgccggcagcggcgagguggacagcuucucccuggggauccugugcgccagcaucaugaucgaggaggugaugcgcucccgguggagccgcaagaugcucaugaccggcacccuggccgucuuccugcuccugaucauggggcagcugaccuggaacgaccucauccgccugugcaucauggugggcgcgaacgccuccgaccggauggggaugggcacgaccuaccuggcccucauggccaccuucaagaugcgcccgauguucgccgugggccugcuguuccggcgccucaccagccgggagguccugcugcucacgaucgggcugucccugguggcgagcguggagcuccccaacucccuggaggagcugggcgacgggcucgccaugggcaucaugaugcugaagcugcucaccgaguuccagccccaccagcuguggaccacccugcucagccugacguucaucaagaccacccugucccucgacuacgccuggaagaccacggccauggcgcugagcaucgucucccuguucccccucugccugagcaccaccucccagaagaccaccuggcugccggugcuccugggcagcuucgggugcaagccccugacgauguuccucaucaccgagaacaagaucuggggccgcaaguccuggccccugaacgaggggaucauggccaucggcaucgucagccugcuccuguccagccugcucaagaacgacgugccccuggccgggccgcugaucgccggcggcaugcucaucgccugcuacgugaucagcggguccagcgcggaccugucccuggagaaggccgccgaggucagcugggagcaggaggccgagcacuccggcaccagccacaacauccucguggaggugcaggacgacgggaccaugaagaucaaggacgaggagcgggacgacacgcugaccauccuggucaaggccacccuccuggcgguguccggcguguaccccaugagcauccccgccacccuguucgucugguacuucuggcagaagaagaagcagcgcuccggggugcucugggacacgcccagcccgcccgagguggagcgggccguccuggacgacggcaucuaccgcauccugcagcggggccugcucgggcgcucccaggugggcgugggggucuuccaggacggcguguuccacaccauguggcacgugacccgcggggccguccugauguaccagggcaagcgccuggagcccagcugggccuccgugaagaaggaccucaucagcuacggcgggggcuggcgguuccagggguccuggaacaccggcgaggaggugcaggucaucgcgguggagccccgcaagaacccgaagaacgugcagacgacccccgggaccuucaagacccccgagggcgaggucggcgccaucgcccuggacuucaagcccgggacgagcggcuccccgaucgugaaccgggaggggaagaucgugggccuguacggcaacggggucgugaccaccagcggcaccuacguguccgccaucgcccaggcgaaggccagccaggaggggccccuccccgagaucgaggacgaggucuucaagaagcgcaaccugacgaucauggaccugcacccgggcagcgggaagacccggcgcuaccuccccgccaucgugcgggaggccaucaagcgcaagcugcgcacccugauccucgcgcccacccggguggucgccuccgagauggccgaggcccugaagggcaugcccauccgcuaccagacgaccgccgucaagagcgagcacaccggccgggagaucguggaccugaugugccacgcgaccuucacgaugcgccuccuguccccgguccgggugcccaacuacaacaugaucaucauggacgaggcccacuucaccgaccccgccagcaucgccgcccgcggguacaucuccacccgggugggcaugggggaggcggccgccaucuucaugaccgccacgcccccgggcagcgucgaggccuucccccaguccaacgcggugauccaggacgaggagcgcgacauccccgagcggagcuggaacuccggguacgacuggaucaccgacuuccccggcaagaccgugugguucgucccgagcaucaaguccggcaacgacaucgccaacugccugcgcaagaacgggaagcgggugauccagcucagccgcaagaccuucgacacggaguaccagaagaccaagaacaacgacugggacuacguggucaccaccgacaucuccgagaugggcgccaacuuccgggccgaccgcgugaucgacccccggcgcugccugaagcccgugauccugaaggacgggcccgagcgggucauccucgcgggcccgaugcccgugacgguggccagcgccgcccagcgccgggggcgcaucggccgcaaccagaacaaggagggcgaccaguacgucuacauggggcagccccugaacaacgacgaggaccacgcccacuggaccgaggcgaagaugcugcucgacaacaucaacacccccgagggcaucaucccggcccuguucgagcccgagcgggagaaguccgccgccaucgacggggaguaccgccugcggggcgaggcccgcaagaccuucguggagcucaugcggcgcggggaccugcccgucuggcugagcuacaagguggcguccgagggcuuccaguacagcgaccggcgcuggugcuucgacggcgagcggaacaaccaggugcucgaggagaacauggacgucgagaucuggaccaaggagggggagcgcaagaagcugcggccccgcuggcuggacgcccggacguacuccgacccgcucgcccugcgcgaguucaaggaguucgccgccggccggcgcagcgugagcggggaccugauccucgagaucggcaagcugccccagcaccugacccuccgggcgcagaacgcccuggacaaccuggugaugcuccacaacuccgagcagggcgggaaggccuaccgccacgccauggaggagcugcccgacaccaucgagacccugaugcuccuggcgcugaucgccguccucacgggcggggugacccuguucuuccugagcggcaaggggcucggcaagaccuccaucggccugcugugcgugaccgccagcuccgcccuccuguggauggccagcgucgagccccacuggaucgcggccuccaucauccuggaguucuuccucauggugcugcugaucccggagcccgaccggcagcgcacgccccaggacaaccagcucgccuacguggucaucgggcugcuguucaugauccucaccguggccgccaacgagaugggccugcuggagaccaccaagaaggaccucgggaucggccacguggcggccgagaaccaccagcacgccacgaugcuggacgucgaccugcggccggccagcgccuggacccucuacgcgguggccaccaccgugaucacgcccaugaugcgccacaccaucgagaacaccaccgccaacaucucccugacggccaucgccaaccaggcggccauccugauggggcucgacaagggcuggcccaucagcaagauggacaucggcgucccccugcuggcccucgggugcuacucccaggugaacccgcugacccugaccgccgcggugcucaugcuggucgcccacuacgccaucaucggccccgggcugcaggccaaggccacccgcgaggcgcagaagcggacggccgccggcaucaugaagaaccccaccguggacgggaucguggccaucgaccucgaccccgucguguacgacaccaaguucgagaagcagcugggccagaucaugcugcucauccugugcaccagccagauccugcucaugcgcacgaccugggcccugugcgaguccaucacccuggcgaccggcccgcucacgacccugugggaggggagccccggcaaguucuggaacaccaccaucgccguguccauggccaacaucuuccgggggagcuaccuggccggcgccggccucgcguucucccugaugaaguccgucgggggcgggcgccggggcaugggggcccagggcgagacgcugggcgagaaguggaagcgccagcucaaccagcuguccaagagcgaguucaacaccuacaagcggagcgggaucauggagguggaccgcuccgaggccaaggagggccugaagcgcggggagaccaccaagcacgccgugagccgcggcaccgcgaagcuccggugguucgucgagcgcaaccuggugaagcccgaggggaaggugaucgaccugggcugcggccgcggcgggugguccuacuacugcgccgggcugaagaaggucacggaggugaagggguacaccaagggcgggcccggccacgaggagccgauccccauggccaccuacggguggaaccucgugaagcugcacagcggcaaggacgucuucuucaugccgcccgagaagugcgacacccugcucugcgacaucggggaguccagcccgaaccccacgaucgaggagggccgcacccugcgggugcugaagaugguggagcccuggcuccgcgggaaccaguucugcaucaagauccugaaccccuacaugccguccgucguggagacccuggagcagaugcagcggaagcacggcggcaugcucgugcgcaacccccugagccggaacuccacccacgagauguacugggucagcugcgggacgggcaacaucguguccgccgugaacaugaccagccgcaugcugcucaaccgcuucaccauggcccaccggaagcccaccuacgagcgcgacgucgaccugggggcgggcacgcggcacguggccguggagcccgaggucgccaaccuggacaucaucggccagcgcaucgagaacaucaagaacgagcacaaguccaccuggcacuacgacgaggacaacccguacaagaccugggccuaccacgggagcuacgaggugaagcccuccggcagcgccuccagcauggugaacggggucgugcggcuccugaccaagcccugggacgucauccccauggugacgcagaucgcgaugaccgacaccaccccguucggccagcagcgcguguucaaggagaaggucgacacgcggacgccccgggccaagcgggggaccacccagaucauggaggugacggccaaguggcuguggggcuuccucucccgcaacaagaagccccggaucugcacccgcgaggaguucacccggaaggugcgcagcaacgccgccaucggcgcggucuucguggacgagaaccaguggaacagcgccaaggaggccguggaggacgagcgguucugggaccugguccaccgcgagcgggagcugcacaagcaggggaagugcgcgaccugcguguacaacaugaugggcaagcgcgagaagaagcucggggaguucggcaaggcgaaggggucccgggccaucugguacauguggcugggcgcccgcuuccuggaguucgaggcccucggcuucaugaacgaggaccacugguucagccgggagaacucccugagcgggguggagggcgaggggcugcacaagcucggcuacauccugcgcgacaucuccaagauccccggcgggaacauguacgccgacgacacggcggggugggacacccgcaucaccgaggacgaccugcagaacgaggccaagaucaccgacaucauggagcccgagcacgcccuccuggccacgagcaucuucaagcugaccuaccagaacaaggucgugcgggugcagcgccccgccaagaacgggaccgucauggacgugaucucccggcgcgaccagcggggcagcggccagguggggaccuacggccuccacacguucaccaacauggagguccagcugauccgccagauggaguccgaggggaucuuccugcccagcgagcucgagaccccgaaccuggcggagcgggugcuggacuggcucgagaagcacggcgccgagcgccugaagcggauggccaucuccggggacgacugcguggucaagcccaucgacgaccgcuucgccaccgcccugaccgcgcucaacgacaugggcaaggugcggaaggacaucccccagugggagcccagcaagggguggaacgacuggcagcaggucccguucugcucccaccacuuccaccagcugaucaugaaggacggccgcgagaucgucgugcccugccggaaccaggacgagcuggugggccgcgcccgggucagccagggggccggcuggucccuccgcgagacggccugccugggcaagagcuacgcccagauguggcagcugauguacuuccaccggcgcgaccuccggcuggcggccaacgccaucugcuccgccgugcccguggacuggguccccaccagccgcaccaccuggagcauccacgcgcaccaccaguggaugacgaccgaggacaugcuguccguguggaaccgcguguggaucgaggagaacccguggauggaggacaagacccacgucagcuccugggaggaggugcccuaccucggcaagcgggaggaccaguggugcgggagccugaucggccugaccgcccgcgccacgugggccaccaacauccagguggccaucaaccagguccggcgccucaucggcaacgagaacuaccuggacuacaugaccuccaugaagcgguucaagaacgagagcgaccccgagggggcgcugugguga

SEQ ID NO: 7959 - RNA, 9879 nt, Artificial Sequence
  derived and/or modified CDS sequence (opt1) from DENV-1__FJ850070__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgccauggaccugggcgagcucugcgaggacaccaugaccuacaagugcccccggaucaccgaggccgagcccgacgacguggacugcuggugcaacgccaccgacacgugggugaccuacgggaccugcagccagaccggcgagcaccggcgcgacaagcgguccguggcccuggcgccccacgucggccuggggcucgagacccgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcgcgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgccaacggcauccucgcccaggggaagaagaugauccgcccccagcccauggagcacaaguacagcuggaaguccuggggcaaggcgaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcugcgcgacagccacacccagaugugcgaccaccggcucauguccgccgcgaucaaggacagcaaggccguccacgccgacaugggcuacuggaucgaguccgagaagaacgagaccuggaagcuggcccgcgccagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgcgggccccuggcaccuggggaagcuggagcucgacuucgaccugugcgagggcaccacggucgugguggacgagcacugcggcuaccgcgggccgucccugcggaccaccaccgucacgggcaagaucauccacgaguggugcugccgcagcugcacccugccgccccugcgguuccgcggggaggacggcugcugguacgggauggagauccggcccgugaaggagaaggaggagaaccuggugcgcuccauggucagcgccggcuccggcgagguggacagcuucagccucgggauccugugcguguccauccugaucgaggaggucaugcggagccgcuggucccggaagaugcucaugaccggcacccuggccguguuccugcuccugaucauggggcagcugacguggaacgaccucauccgccugugcaucauggugggcgccaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggccuccgucgagcuccccaacagccuggaggagcugggcgacgggcucgccaugggcaucaugaugcugaagcugcucaccgacuuccagccccaccagcuguggaccacgcugcucucccugaccuucauccggaccagccugucccucgacuacgcguggaagaccauggccauggcccugagcaucgugucccuguucccccucugccugagcacgaccucccagaagaccaccuggcugccgguccuccugggcagcuucgggugcaagccccugacgauguuccucaucaccgagaacaagaucuggggccgcaaguccuggcccaucaacgaggggaucauggccgugggcaucgugagcauccugcuguccagccuccugaagaacgacgucccccuggcggggccgcucaucgccggcggcaugcugaucgccugcuacgugaucagcggguccagcgccgaccugucccucgagaaggccgcggaggugagcugggaggaggaggccgagcacuccggcaccagccacaacauccuggucgaggugcaggacgacgggaccaugaagaucaaggacgaggagcgggacgacacccugacgauccuccugaaggccacccugcucgccgccuccggcguguaccccaugagcauccccgcgacccuguucgucugguacuucuggcagaagaagaagcagcgcuccggggugcugugggacacccccagcccgcccgagguggagcgggccguccuggacgacggcaucuaccgcauccuccagcggggccugcuggggcgcucccaggugggcgugggggucuuccaggacggcguguuccacacgauguggcacgugacccgcggggccguccucauguaccagggcaagcgccuggagcccagcugggccuccgugaagaaggaccugaucagcuacggcgggggcuggcgguuccagggguccuggaacaccggcgaggaggugcaggucaucgccguggagcccgggaagaacccgaagaacgugcagaccacgcccggcaccuucaagacccccgagggcgaggucggggcgaucgcccucgacuucaagcccggcaccagcggguccccgaucgugaaccgcgagggcaagaucgugggccuguacgggaacggcgucgugacgaccagcgggaccuacguguccgccaucgcccaggccaaggcgagccaggagggcccccugcccgagaucgaggacgaggucuucaagaagcggaaccucaccaucauggaccugcacccggggagcggcaagacgcgccgguaccugcccgccaucgugcgcgaggccaucaagcggaagcuccgcacccugauccuggcccccacccgcguggucgcguccgagauggccgaggcccucaagggcaugcccauccgguaccagaccacggccgucaagagcgagcacaccgggcgcgagaucguggaccugaugugccacgccaccuucaccaugcggcugcucuccccgguccgcgugcccaacuacaacaugaucaucauggacgaggcgcacuucacggaccccgccagcaucgccgcccggggcuacaucuccacccgcguggggaugggcgaggccgcggccaucuucaugaccgccacgccgcccgggagcgucgaggccuucccccaguccaacgccgugauccaggacgaggagcgggacauccccgagcgcagcuggaacuccggcuacgacuggaucacggacuuccccggcaagaccgugugguucguccccagcaucaaguccgggaacgacaucgcgaacugccugcggaagaacggcaagcgcgugauccagcugagccggaagaccuucgacaccgaguaccagaagacgaagaacaacgacugggacuacguggucaccaccgacaucuccgagaugggggccaacuuccgcgccgaccgggugaucgacccccgccggugccucaagcccgugauccugaaggacggccccgagcgcgucauccuggccgggccgaugcccgugaccguggcgagcgccgcccagcggcgcggccggaucggccgcaaccagaacaaggagggggaccaguacaucuacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucgucgagcugaugcgccggggcgaccuccccguguggcugagcuacaaggucgccuccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcgcgcacguacuccgacccgcuggcccuccgggaguucaaggaguucgccgccgggcgccggagcgucagcggcgaccugauccuggagaucggcaagcucccccagcaccugacccugcgcgcccagaacgcgcucgacaaccuggugaugcugcacaacuccgagcagggcgggaaggccuaccggcacgccauggaggagcuccccgacaccaucgagacccugaugcugcucgcccugaucgcggugcugaccgggggcgucacccucuucuuccugagcgggaagggccugggcaagaccuccaucgggcuccugugcgugauggccagcuccgcccugcucuggauggccagcguggagccccacuggaucgccgcguccaucauccuggaguucuuccugaugguccuccugaucccggagcccgaccgccagcggacgccccaggacaaccagcuggccuacguggugaucggccuccuguucaugauccugaccgucgccgccaacgagauggggcuccuggagacgaccaagaaggaccugggcaucgggcacguggccgcggagaaccaccaccacgccaccaugcucgacguggaccugcacccggccagcgccuggacccuguacgccgucgcgacgaccgugaucacccccaugaugcgccacaccaucgagaacacgaccgccaacaucucccucaccgccaucgccaaccaggccgcgauccugaugggccuggacaagggcuggcccaucagcaagauggacaucggggugccccuccuggcccugggcugcuacucccaggucaacccgcucacccugacggccgccgugcugaugcucguggcgcacuacgccaucaucgggcccggccugcaggccaaggccacccgggaggcccagaagcgcaccgcggccgggaucaugaagaaccccaccgucgacggcaucgugacgaucgaccuggaccccguggucuacgacgccaaguucgagaagcagcucggccagaucaugcugcugauccucugcaccagccagauccugcugaugcgcaccaccugggcccucugcgaguccaucacgcuggccaccgggccgcugaccacccucugggagggcagccccgggaaguucuggaacacgaccaucgcgguguccauggccaacaucuuccggggcagcuaccuggccggcgccgggcuggccuucucccucaugaagucccugggcgggggccgccgggggaccggcgcgcagggcgagacccugggggagaaguggaagcgccagcucaaccagcuguccaagagcgaguucaacacguacaagaaguccggcaucauggagguggaccgguccgaggccaaggaggggcugaagcgcggcgagaccaccaagcacgccgucagccgggggaccgccaagcugcgcugguucguggagcggaaccucgugaagcccgagggcaaggucaucgaccugggcugcgggcgcggcgggugguccuacuacugcgcgggccugaagaaggugacggaggugaagggguacaccaagggcggccccgggcacgaggagccgauccccauggccaccuacggcuggaaccucgucaagcugcacagcgggaaggacguguucuucacgccgcccgagaagugcgacacccugcucugcgacaucggcgaguccagcccgaaccccacgaucgaggaggggcggacccugcgcgugcugaagauggucgagcccuggcuccggggcaaccaguucugcaucaagauccugaaccccuacaugccguccgugguggagacccuggagcagaugcagcgcaagcacggcgggaugcucguccggaacccccugagccgcaacuccacccacgagauguacugggugagcugcggcacggggaacaucguguccgccgucaacaugaccagccggaugcugcucaaccgcuucaccauggcccaccggaagcccaccuacgagcgcgacguggaccugggcgccggcacgcgccacguggcggucgagcccgagguggccaaccuggacaucaucgggcagcggaucgagaacaucaagaacgagcacaaguccaccuggcacuacgacgaggacaacccguacaagaccugggccuaccacggcagcuacgaggugaaguccagcggguccgccagcuccauggucaacggcguggugcgccuccugaccaagcccugggacgucauccccauggugacgcagaucgccaugaccgacaccacccccuucgggcagcagcgggucuucaaggagaagguggacacgcgcaccccgcgggcgaagcgcggcaccgcccagaucauggaggugaccgccaaguggcuguggggcuuccucagccggaacaagaagccccgcaucugcacgcgggaggaguucacccgcaagguccggagcaacgccgccaucggggcgguguucguggacgagaaccaguggaacuccgccaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggcgaagggcagccgcgccaucugguacauguggcugggcgcccgguuccuggaguucgaggcccucggguucaugaacgaggaccacugguucucccgcgagaacagccuguccggcgucgagggggagggccugcacaagcucggguacauccugcgggacaucagcaagauccccggcggcaacauguacgccgacgacaccgcggggugggacacgcgcaucaccgaggacgaccugcagaacgaggccaagaucaccgacaucauggagccggagcacgcccuccuggccaccuccaucuucaagcugacguaccagaacaagguggugcggguccagcgccccgccaagagcggcaccgugauggacgugaucucccgccgggaccagcgcgggagcggccaggucggcaccuacgggcucaacaccuucacgaacauggaggugcagcugauccggcagauggaguccgagggcaucuucagccccuccgagcuggagacccccaaccucgcgaagcgcgugcuggacuggcuggagaagcacggggccgagcggcucaagcgcauggccaucagcggcgacgacugcgucgugaagccgaucgacgaccgguucgccaccgcccugaccgcgcugaacgacauggggaaggugcgcaaggacaucccccagugggagcccuccaagggcuggaacgacuggcagcagguccccuucugcagccaccacuuccaccagcucaucaugaaggacggccgggagaucguggugccgugccgcaaccaggacgagcuggucgggcgggcccgcgugucccagggcgccggguggagccugcgggagacggccugccucggcaagagcuacgcccagauguggcagcugauguacuuccaccgccgggaccugcgccucgcggccaacgccaucugcuccgccgugcccgucgacugggugcccaccagccggaccaccugguccauccacgcgcaccaccaguggaugaccacggaggacaugcugagcguguggaaccgcgucuggaucgaggagaaccccuggauggaggacaagacccacguguccagcugggaggaggugccguaccuggggaagcgggaggaccaguggugcggcucccucaucggccugaccgcccgcgccaccugggccacgaacauccaggucgccaucaaccaggugcgccggcugaucgggaacgagaacuaccucgacuacaugaccagcaugaagcgcuucaagaacgaguccgaccccgagggcgcgcugugguga

SEQ ID NO: 7960 - RNA, 9879 nt, Artificial Sequence
  derived and/or modified CDS sequence (opt1) from DENV-1__FJ850071__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgccauggaccugggcgagcucugcgaggacaccaugaccuacaagugcccccggaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacccgcaccgagaccuggaugagcuccgagggcgcguggaagcagauccagaagguggagaccugggcccugcggcaccccggguucaccgugaucgcccuguuccucgcccacgcgaucggcaccagcaucacccagaaggggaucaucuucauccugcugaugcucgugacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgccaacggcauccucgcccaggggaagaagaugauccgcccccagcccauggagcacaaguacagcuggaaguccuggggcaaggcgaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcugcgcgacagccacacccagaugugcgaccaccggcucauguccgccgcgaucaaggacagcaaggccguccacgccgacaugggcuacuggaucgaguccgagaagaacgagaccuggaagcuggcccgcgccagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgcgggccccuggcaccuggggaagcuggagcucgacuucgaccugugcgagggcaccacggucgugguggacgagcacugcggcuaccgcgggccgucccugcggaccaccaccgucacgggcaagaucauccacgaguggugcugccgcagcugcacccugccgccccugcgguuccgcggggaggacggcugcugguacgggauggagauccggcccgugaaggagaaggaggagaaccuggugcgcuccauggucagcgccggcuccggcgagguggacagcuucagccucgggauccugugcguguccauccugaucgaggaggucaugcggagccgcuggucccggaagaugcucaugaccggcacccuggccguguucuuccugcucaucauggggcagcugacguggaacgaccugauccgccucugcaucauggugggcgccaacgccagcgaccgcauggggaugggcaccaccuaccuggcccugauggccaccuucaagaugcggccgauguucgccgucgggcuccuguuccgcaagcugacgucccgggaggugcuccugcugaccaucgggcucagccugguggccuccgucgagcugcccaacagccucgaggagcugggcgacgggcuggccaugggcaucaugaugcucaagcugcugaccgacuuccagccccaccagcucuggaccacgcugcugucccucaccuucauccgcaccagccugucccuggacuacgcguggaagaccauggccauggcccucagcaucgugucccuguucccccugugccucagcacgaccucccagaagaccaccuggcugccgguccugcucggcagcuucgggugcaagccccugacgauguuccugaucaccgagaacaagaucuggggccggaaguccuggcccaucaacgaggggaucauggccgugggcaucgugagcauccuccuguccagccugcucaagaacgacgucccccuggcggggccgcugaucgccggcggcaugcucaucgccugcuacgugaucagcggguccagcgccgaccugucccuggagaaggccgcggaggugagcugggaggaggaggccgagcacuccggcaccagccacaacauccucgucgaggugcaggacgacgggaccaugaagaucaaggacgaggagcgcgacgacacccugacgauccugcucaaggccacccugcuggccguguccggcgucuaccccaugagcauccccgccacccucuucgugugguacuucuggcagaagaagaagcagcgguccggggugcugugggacacccccagcccgcccgaggucgagcgcgcggugcuggacgacggcaucuaccggauccugcagcgcggccuccuggggcggucccaggugggcgucgggguguuccaggacggcguguuccacacgauguggcacgucacccgcggggccgugcugauguaccagggcaagcggcucgagcccagcugggccuccgugaagaaggaccugaucagcuacggcgggggcuggcgcuuccagggguccuggaacaccggcgaggagguccaggugaucgccguggagcccgggaagaacccgaagaacguccagaccacgcccggcaccuucaagacccccgagggcgaggugggggccaucgcgcuggacuucaagcccggcaccagcggguccccgaucgugaaccgggagggcaagaucgucggccucuacgggaacggcguggugacgaccagcgggaccuacgucuccgccaucgcccaggccaaggccagccaggagggcccccugcccgagaucgaggacgagguguucaagaagcgcaaccugaccaucauggaccuccacccggggagcggcaagacgcggcgcuaccugcccgcgaucgugcgggaggccaucaagcgcaagcugcggacccucauccuggcccccacccgcgucguggccuccgagauggcggaggcccugaagggcaugcccauccgcuaccagaccacggccgucaagagcgagcacaccgggcgggagaucgucgaccucaugugccacgccaccuucaccaugcgccugcuguccccggugcgggugcccaacuacaacaugaucaucauggacgaggcccacuucacggaccccgcgagcaucgccgcccgcggcuacaucuccacccgggucgggaugggcgaggccgccgcgaucuucaugaccgccacgccgcccgggagcguggaggccuucccccaguccaacgccgugauccaggacgaggagcgcgacauccccgagcggagcuggaacuccggcuacgacuggaucacggacuuccccggcaagaccgucugguucgugcccagcaucaaguccgggaacgacaucgccaacugccuccgcaagaacggcaagcgggugauccagcugagccgcaagaccuucgacaccgaguaccagaagacgaagaacaacgacugggacuacgucgugaccaccgacaucuccgagaugggggcgaacuuccgggccgaccgcgugaucgacccccggcgcugccugaagcccgucauccucaaggacggccccgagcgggugauccuggccgggccgaugcccgugaccgucgccagcgcggcccagcgccggggccgcaucggccggaaccagaacaaggagggggaccaguacaucuacaugggccagccccugaacaacgacgaggaccacgcccacuggacggaggccaagaugcuccuggacaacaucaacacccccgaggggaucaucccggcccuguucgagcccgagcgcgagaaguccgcggccaucgacggcgaguaccgccuccgcggggaggcccgcaagaccuucguggagcugaugcggcgcggcgaccugcccgucuggcucagcuacaagguggccuccgagggcuuccaguacagcgaccggcgcuggugcuucgacggggagcggaacaaccaggugcuggaggagaacauggacgucgagaucuggaccaaggagggcgagcgcaagaagcugcggccccgcuggcucgacgcccggacguacuccgacccgcuggcgcugcgcgaguucaaggaguucgccgccgggcggcgcagcgugagcggcgaccucauccuggagaucggcaagcugccccagcaccucacccugcgggcccagaacgcccuggacaaccucgugaugcugcacaacuccgagcagggcgggaaggcguaccgccacgccauggaggagcugcccgacaccaucgagacccucaugcugcuggcccucaucgccguccugaccgggggcgugacgcuguucuuccucagcgggaagggccugggcaagaccuccaucgggcugcucugcgugauggcgagcuccgcccugcuguggauggccagcgucgagccccacuggaucgccgccuccaucauccucgaguucuuccugauggugcugcucaucccggagcccgaccggcagcgcacgccccaggacaaccagcuggcguacguggucaucggccuccucuucaugauccugaccguggccgccaacgagauggggcugcucgagacgaccaagaaggaccugggcaucgggcacguggccgccgagaaccaccaccacgcgaccaugcuggacgucgaccuccggccggccagcgccuggacccuguacgccguggccacgaccgugaucacccccaugaugcgccacaccaucgagaacacgaccgcgaacaucucccugaccgccaucgccaaccaggccgccauccucaugggccuggacaagggcuggcccaucagcaagauggacaucggggucccccugcucgcgcugggcugcuacucccaggugaacccgcugacccucacggccgccgugcugaugcuggucgcccacuacgcgaucaucgggcccggccuccaggccaaggccacccgggaggcccagaagcgcaccgccgcggggaucaugaagaaccccaccguggacggcaucgugacgaucgaccuggaccccgucguguacgacgccaaguucgagaagcagcugggccagaucaugcuccugauccugugcaccagccagauccuccugaugcgcaccaccugggcccugugcgaguccaucacgcucgccaccgggccgcugaccacccugugggagggcagccccgggaaguucuggaacacgaccaucgccguguccauggcgaacaucuuccggggcagcuaccucgccggcgccgggcuggccuucucccugaugaagucccucggcgggggccgccgggggaccggcgcccagggcgagacccugggggagaaguggaagcgccagcugaaccagcucuccaagagcgaguucaacacguacaagaaguccggcaucauggaggucgaccgguccgaggcgaaggaggggcugaagcgcggcgagaccaccaagcacgccgugagccgggggaccgccaagcugcgcugguucguggagcggaaccuggucaagcccgagggcaaggugaucgaccucggcugcgggcgcggcgggugguccuacuacugcgccggccugaagaaggugacggaggucaagggguacaccaagggcggccccgggcacgaggagccgauccccauggcgaccuacggcuggaaccuggugaagcuccacagcgggaaggacguguucuucacgccgcccgagaagugcgacacccugcugugcgacaucggcgaguccagcccgaaccccacgaucgaggaggggcggacccuccgcguccugaagaugguggagcccuggcugcggggcaaccaguucugcaucaagauccucaaccccuacaugccguccguggucgagacccuggagcagaugcagcgcaagcacggcgggaugcuggugcggaacccccucagccgcaacuccacccacgagauguacugggugagcugcggcacggggaacaucgucuccgccgugaacaugaccagccggaugcugcugaaccgcuucaccauggcccaccggaagcccaccuacgagcgcgacguggaccucggcgccggcacgcgccacgucgccguggagcccgagguggcgaaccuggacaucaucgggcagcggaucgagaacaucaagaacgagcacaaguccaccuggcacuacgacgaggacaacccguacaagaccugggccuaccacggcagcuacgaggucaagcccuccgggagcgccuccagcauggugaacggcgugguccgccugcucaccaagcccugggacgugauccccauggucacgcagaucgccaugaccgacaccaccccguucgggcagcagcggguguucaaggagaagguggacacgcgcacgccccgggccaagcgcggcaccgcgcagaucauggaggucaccgccaaguggcuguggggcuuccugucccggaacaagaagccccgcaucugcacgcgggaggaguucacccgcaaggugcggagcaacgccgccaucggggccguguucgucgacgagaaccaguggaacagcgcgaaggaggccguggaggacgagcgcuucugggaccucgugcaccgggagcgcgagcugcacaagcagggcaagugcgcgaccugcgucuacaacaugauggggaagcgggagaagaagcugggcgaguucgggaaggccaagggcucccgcgcgaucugguacauguggcucggcgcccgguuccuggaguucgaggcccugggguucaugaacgaggaccacugguucagccgcgagaacucccucagcggcguggagggggagggccugcacaagcugggguacauccuccgggacaucuccaagaucccgggcggcaacauguacgccgacgacaccgccgggugggacacgcgcaucaccgaggacgaccugcagaacgaggcgaagaucaccgacaucauggagcccgagcacgcccugcucgccaccagcaucuucaagcugacguaccagaacaaggugguccgggugcagcgccccgccaaguccggcaccgugauggacgucaucagccgccgggaccagcgcggguccggccaggugggcaccuacgggcugaacaccuucacgaacauggaggugcagcucauccggcagauggagagcgagggcaucuucucccccagcgagcuggagaccccgaaccuggccaagcgcguccucgacuggcuggagaagcacggggcggagcggcugaagcgcauggccaucuccggcgacgacugcguggugaagcccaucgacgaccgguucgccaccgcccucaccgcccugaacgacauggggaagguccgcaaggacaucccccagugggagcccagcaagggcuggaacgacuggcagcaggucccguucugcucccaccacuuccaccagcugaucaugaaggacggccgggagaucgugguccccugccgcaaccaggacgagcucguggggcgggcgcgcgugagccagggcgccggguggucccugcgggagacggccugccugggcaagagcuacgcccagauguggcagcucauguacuuccaccgccgggaccugcgccuggccgcgaacgccaucugcagcgccguccccguggacugggugcccaccucccggaccaccuggagcauccacgcccaccaccaguggaugaccacggaggacaugcucuccgucuggaaccgcguguggaucgaggagaacccguggauggaggacaagacccacgugagcuccugggaggagguccccuaccuggggaagcgggaggaccaguggugcggcagccugaucggccucaccgcgcgcgccaccugggccacgaacauccagguggccaucaaccaggugcgccggcugaucgggaacgagaacuaccuggacuacaugaccuccaugaagcgcuucaagaacgagagcgaccccgagggcgcccucugguga

SEQ ID NO: 7961 - RNA, 9879 nt, Artificial Sequence
  derived and/or modified CDS sequence (opt1) from DENV-1__FJ850073__SS-prME
agcgugaccaugcugcucaugcugcugcccaccgcccucgccuuccaccugaccacccggggcggggagccccacaugaucgugagcaagcaggagcggggcaagagccuccuguucaagaccuccgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgggacaagcgguccguggcccuggcgccccacgugggccuggggcucgagacgcggaccgagaccuggaugagcuccgagggcgccuggaagcagauccagaaggucgagaccugggcccugcggcaccccggguucacggugaucgcccuguuccucgcgcacgccaucggcaccagcaucacccagaaggggaucaucuucauccugcugaugcucgugacccccuccauggccaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgcggugcuccgcaagcugugcaucgaggccaagaucagcaacaccaccacggacucccggugcccgacccagggcgaggccacccugguggaggagcaggacgccaacuucgucugccgccggaccuucguggaccgcggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccggcugaagauggacaagcucacccugaagggcaccuccuacgucaugugcaccgggagcuucaagcuggagaaggagguggcggagacgcagcacggcaccgugcugguccaggugaaguacgagggcaccgacgcccccugcaagauccccuucuccacccaggacgagaagggggugacgcagaacggccgccucaucaccgccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccacggcccgcggggcccgccggauggccauccucggcgacaccgcgugggacuucgggagcaucggcggcguguucaccuccguggggaagcugguccaccagguguucggcaccgccuacggggugcuguucagcggcgucuccuggacgaugaagaucgggaucggcauccuccugaccuggcugggccucaacagccgcuccaccagccuguccaugaccugcaucgccguggggauggugacgcuguaccucggcgucauggugcaggccgacagcgggugcgugaucaacuggaagggccgcgagcugaagugcggguccggcaucuucgucaccaacgaggugcacaccuggaccgagcaguacaaguuccaggccgacagcccgaagcggcugagcgcggccaucggccgcgccugggaggagggggugugcggcauccgguccgccacccgccucgagaacaucauguggaagcagaucagcaacgagcugaaccacauccugcucgagaacgacaucaaguucacggucgugguggggaacgccgacggcauccuggcgcaggggaagaagaugauccggccccagcccauggagcacaaguacuccuggaaguccuggggcaaggccaagaucaucggcgccgacauccagaacaccaccuucaucaucgacgggcccgacacccuggagugcccggacgagcagcgcgccuggaacaucugggaggucgaggacuacggcuucgggaucuucacgaccaacaucuggcucaagcugcgggacuccuacacccagaugugcgaccaccgccugaugagcgcggccaucaaggacuccaaggccgugcacgccgacaugggcuacuggaucgagagcgagaagaacgagaccuggaagcucgcccgggcguccuucaucgaggugaagacgugcaucuggcccaagagccacacccugugguccaacggcguccuggagagcgagaugaucauccccaagauguacgggggccccgugucccagcacaacuaccgcccgggguacuucacccagaccgccggccccuggcaccucgggaagcuggagcuggacuucgaccucugcgagggcacgaccguggucguggacgagcacugcggcagccgggggcccucccugcgcaccaccacggugaccggcaagaucauccacgaguggugcugccggagcugcacccugccgccccuccgcuuccgcggggaggacggcugcugguacgggauggagauccgccccgucaaggagaaggaggagaaccuggugcgguccauggugagcgccggcagcggcgaggucgacuccuucagccugggggugcucugcguguccaucaugaucgaggaggucaugcgcagccgguggucccgcaagaugcugaugaccggcacgcuggccguguuccuccugcugaucauggggcagcucaccuggaacgaccugauccgccugugcaucauggugggcgccaacgcgagcgacaagauggggaugggcaccaccuaccucgcccugauggccacguucaagaugcggcccauguucgccgucgggcuccuguuccgccggcugaccucccgcgaggugcugcuccugaccaucgggcugagccucgucgccuccguggagcugccgaacagccuggaggagcucggcgacgggcuggcgaugggcaucaugaugcugaagcuccugaccgaguuccagccccaccagcuguggacgacccuccugucccugaccuucaucaagaccacgcucagccuggacuacgccuggaagaccaccgccauggugcuguccaucgucagccucuucccccugugccuguccaccacgagccagaagaccaccuggcuccccgugcugcugggcuccuucgggugcaagccgcucaccauguuccugaucaccgagaacgagaucuggggccgcaagagcuggccccugaacgaggggaucauggccaucggcaucguguccauccuccugagcagccugcucaagaacgacgucccccuggcggggccccugaucgccggcggcaugcucaucgccugcuacgugaucuccgggagcuccgccgaccugagccuggagaaggccgcggagguguccugggaggaggaggucgagcacagcggcacgucccacaacauccucguggaggugcaggacgacgggaccaugaagaucaaggacgaggagcgcgacgacacccugaccauccugcucaaggccacgcugcuggccgucagcggcguguacccgauguccauccccgccacccucuucgugugguacuucuggcagaagaagaagcagcggagcgggguccugugggacacccccagcccgcccgagguggagcgcgccgugcuggacgacggcaucuaccggauccugcagcgcggccuccuggggcggagccaggucggcguggggguguuccaggacggcgucuuccacaccauguggcacgugacgcgcggggcggugcugauguaccagggcaagcggcucgagcccuccugggccagcgucaagaaggaccugaucuccuacggcgggggcuggcgcuuccaggggagcuggaacaccggcgaggagguccaggugaucgccgucgagcccgggaagaaccccaagaacgugcagaccacccccggcacguucaagacccccgagggcgaggugggggccaucgcccuggacuucaagcccggcaccuccgggagccccaucgucaaccgggagggcaagaucgugggccucuacgggaacggcguggucaccacguccgggaccuacgugagcgcgaucgcccaggccaaggccagccaggagggcccgcugcccgagaucgaggacgagguguucaagaagcgcaaccugaccaucauggaccuccaccccggguccggcaagacccggcgcuaccugccggccaucguccgggaggcgaucaagcgcaagcugcggacgcucauccuggcccccacccgcgugguggccagcgagauggccgaggcgcugaagggcaugcccauccgcuaccagaccaccgccgucaaguccgagcacacggggcgggagaucguggaccucaugugccacgccaccuucaccaugcgccugcugagccccgugcgggucccgaacuacaacaugaucaucauggacgaggcccacuucaccgaccccgccuccaucgcggcccgcggcuacaucagcacgcggguggggaugggcgaggccgccgccaucuucaugaccgcgacgccgcccggguccguggaggccuucccgcagagcaacgccgucauccaggacgaggagcgcgacauccccgagcgguccuggaacagcggcuacgacuggaucaccgacuuccccggcaagacggugugguucgugcccuccaucaagagcgggaacgacaucgccaacugccuccgcaagaacggcaagcgggucauccagcugucccgcaagaccuucgacaccgaguaccagaagaccaagaacaacgacugggacuacguggugacgaccgacaucagcgagaugggggccaacuuccgggcggaccgcgucaucgacccgcggcgcugccugaagcccgugauccucaaggacggccccgagcgggucauccuggccgggcccaugccggugaccguggccuccgccgcgcagcgccggggccgcaucggccggaaccagaacaaggagggggaccaguacgucuacaugggccagccccugaacaacgacgaggaccacgcccacuggaccgaggccaagaugcuccuggacaacaucaacacgcccgaggggaucauccccgcccuguucgagccggagcgcgagaaguccgccgcgaucgacggcgaguaccgccuccgcggggaggcccgcaagaccuucguggagcugaugcggcgcggcgaccugcccguguggcucuccuacaaggucgccagcgagggcuuccaguacuccgaccggcgcuggugcuucgacggggagcggaacaaccaggugcuggaggagaacauggacguggagaucuggaccaaggagggcgagcgcaagaagcugcggccccgcuggcucgacgcccggaccuacagcgacccccuggcccugcgcgaguucaaggaguucgcggccgggcggcgcagcgucuccggcgaccucauccuggagaucggcaagcugccgcagcaccucacccugcgggcccagaacgcccuggacaaccucgugaugcugcacaacagcgagcagggcgggaaggccuaccgccacgcgauggaggagcugcccgacacgaucgagacccucaugcugcuggcccucauggccgugcugaccgggggcgucacccuguucuuccucuccgggaagggccugggcaagacgagcaucgggcugcucugcgugauggccuccagcgcgcugcuguggauggccuccguggagccccacuggaucgccgccagcaucauccucgaguucuuccugaugguccugcucauccccgagccggaccggcagcgcacgccccaggacaaccagcuggccuacguggugaucggccuccucuucaugauccugaccgucgcggccaacgagauggggcugcucgagaccacgaagaaggaccugggcaucgggcacguggccgccgagaaccaccagcacgccaccaugcuggacguggaccuccaccccgcguccgccuggacccuguacgccgucgccaccacggugaucaccccgaugaugcggcacaccaucgagaacaccacggccaacaucagccugaccgcgaucgccaaccaggccgccauccucaugggccuggacaagggcuggcccaucuccaagauggaccugggggugccccuccuggcccugggcugcuacagccaggucaacccccucacccugaccgcggccgugcugaugcucguggcccacuacgccaucaucgggccgggccugcaggcgaaggccacgcgcgaggcccagaagcggaccgccgccgggaucaugaagaaccccaccgucgacggcaucguggcgaucgaccuggaccccguggucuacgacgccaaguucgagaagcagcucggccagaucaugcugcugauccucugcaccucccagauccugcugaugcgcacgaccugggcccucugcgagagcaucacccuggccaccgggccccugacgacccucugggagggcuccccggggaaguucuggaacaccaccaucgccgugagcauggcgaacaucuuccgcggcuccuaccuggccggcgccgggcuggccuucagccucaugaagucccugggcgggggccggcgcgggacgggcgcccagggcgagacccugggggagaaguggaagcggcagcucaaccagcugagcaagagcgaguucaacaccuacaagcgcuccggcaucauggagguggaccggagcgaggcgaaggaggggcugaagcgcggcgagaccacgaagcacgccgucucccgggggaccgccaagcugcgcugguucguggagcggaaccucgugaagcccgagggcaaggucaucgaccugggcugcgggcgcggcggguggagcuacuacugcgccggccugaagaaggugaccgaggugaagggguacaccaagggcggccccgggcacgaggagcccaucccgauggcgaccuacggcuggaaccucgucaagcugcacuccgggaaggacguguucuucaugccgcccgagaagugcgacacgcugcucugcgacaucggcgagagcucccccaacccgaccaucgaggaggggcggacccugcgcgugcugaagauggucgagcccuggcuccggggcaaccaguucugcaucaagauccugaaccccuacaugcccagcgugguggagacccuggagcagaugcagcgcaagcacggcgggaugcucguccggaacccgcugucccgcaacagcacgcacgagauguacuggguguccugcggcaccgggaacaucgugagcgccgucaacaugaccucccggaugcugcucaaccgcuucaccauggcccaccggaagcccacguacgagcgcgacguggaccugggcgccggcacccgccacguggccgucgagcccgagguggcgaaccuggacaucaucgggcagcggaucgagaacaucaagaacgagcacaagagcaccuggcacuacgacgaggacaaccccuacaagaccugggccuaccacggcuccuacgaggucaagccgagcggguccgccagcuccauggugaacggcgugguccgccuccugacgaagcccugggacgugauccccauggugacccagaucgccaugaccgacaccacgcccuucgggcagcagcgggucuucaaggagaagguggacacccgcaccccgcgggccaagcgcggcaccgcgcagaucauggaggugacggccaaguggcuguggggcuuccucagccggaacaagaagccccgcaucugcacccgggaggaguucacccgcaagguccggagcaacgccgccaucggggccguguucguggacgagaaccaguggaacuccgcgaaggaggccgucgaggacgagcgcuucugggaccuggugcaccgggagcgcgagcugcacaagcagggcaagugcgcgaccugcguguacaacaugauggggaagcgggagaagaagcucggcgaguucgggaaggccaagggcagccgcgcgaucugguacauguggcugggcgcccgguuccuggaguucgaggcccucggguucaugaacgaggaccacugguucucccgcgagaacagccuguccggcgucgagggggagggccugcacaagcucggguacauccugcgggacaucagcaagauccccggcggcaacauguacgccgacgacacggccgggugggacacccgcaucaccgaggacgaccugcggaacgaggcgaagaucaccgacaucauggagccggagcacgcccuccuggccacguccaucuucaagcugaccuaccagaacaagguggugcgcguccagcgccccgccaagaacggcaccgugauggacgugaucagccggcgcgaccagcggggguccggccaggucggcaccuacgggcucaacacguucaccaacauggaggugcagcugauccgccagauggagagcgagggcaucuucuucuccagcgagcuggagucccccaaccucgccgagcgggugcuggacuggcuggagaagcacggggcggagcgccucaagcggauggccaucagcggcgacgacugcgucgugaagcccaucgacgaccgcuucgccaccgcccugaucgcccugaacgacauggggaaggugcggaaggacaucccgcagugggagcccuccaagggcuggaacgacuggcagcagguccccuucugcagccaccacuuccaccagcucaucaugaaggacggccgcgagaucguggugcccugccggaaccaggacgagcuggucgggcgcgcgcgggugucccagggcgccggguggagccugcgcgagaccgccugccucggcaagagcuacgcccagauguggcagcugauguacuuccaccggcgcgaccugcggcucgccgcgaacgccaucugcuccgccgugccggucgacugggugcccacgagccgcaccaccugguccauccacgcccaccaccaguggaugaccaccgaggacaugcugagcguguggaaccgggucuggaucgaggagaaccccuggauggaggacaagacgcacguguccagcugggaggaggugcccuaccuggggaagcgcgaggaccaguggugcggcucccucaucggccugaccgcgcgcgccaccugggccaccaacauccaggucgccaucaaccaggugcggcgccugaucgggaacggcaacuaccucgacuacaugacgagcaugaagcgguucaagaacgaguccgacccggagggggcccugugguga

SEQ ID NO: 7962 - RNA, 9879 nt, Artificial Sequence
  derived and/or modified CDS sequence (opt1) from DENV-1__FJ850075__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgugacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgccaacggcauccucgcccaggggaagaagaugauccgcccccagcccauggagcacaaguacagcuggaaguccuggggcaaggcgaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcugcgcgacagccacacccagaugugcgaccaccggcucauguccgccgcgaucaaggacagcaaggccguccacgccgacaugggcuacuggaucgaguccgagaagaacgagaccuggaagcuggcccgcgccagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgcgggccccuggcaccuggggaagcuggagcucgacuucgaccugugcgagggcaccacggucgugguggacgagcacugcggcuaccgcgggccgucccugcggaccaccaccgucacgggcaagaccauccacgaguggugcugccgcagcugcacccugccgccccugcgguuccgcggggaggacggcugcugguacgggauggagauccggcccgugaaggagaaggaggagaaccuggugcgcuccauggucagcgccggcuccggcgagguggacagcuucagccucgggauccugugcguguccauccugaucgaggaggucaugcggagccgcuggucccggaagaugcucaugaccggcacgcuggccguguuccugcuccugaucauggggcagcugaccuggaacgaccucauccgccugugcaucauggugggcgccaacgccagcgaccgcauggggaugggcaccaccuaccuggcgcucauggccacguucaagaugcggccgauguucgccgucggccugcuguuccgccggcucaccucccgcgaggugcugcugcucaccaucgggcugagccugguggccuccgucgagcuccccaacagccuggaggagcugggcgacgggcucgccaugggcaucaugaugcugaagcugcucaccgacuuccagccccaccagcuguggacgacccugcucucccugaccuucauccggaccagccugucccucgacuacgcguggaagacgauggccauggcccugagcaucgugucccuguucccccucugccugagcaccaccucccagaagaccacguggcugccgguccuccugggcagcuucgggugcaagccccugaccauguuccucaucaccgagaacaagaucuggggccgcaaguccuggcccaucaacgaggggaucauggccgugggcaucgugagcauccugcuguccagccuccugaagaacgacgucccccuggcggggccgcucaucgccggcggcaugcugaucgccugcuacgugaucagcggguccagcgccgaccugucccucgagaaggccgcggaggugagcugggaggaggaggccgagcacuccggcaccagccacaacauccuggucgaggugcaggacgacgggaccaugaagaucaaggacgaggagcgggacgacacgcugaccauccuccugaaggccacccugcucgccguguccggcgucuaccccaugagcauccccgccacccuguucgugugguacuucuggcagaagaagaagcagcgcuccggggugcugugggacacgcccagcccgcccgaggucgagcgggcggugcuggacgacggcaucuaccgcauccuccagcggggccugcuggggcgcucccaggugggcgucgggguguuccaggacggcguguuccacaccauguggcacgucacccgcggggccgugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagacgacccccggcaccuucaagacccccgagggcgaggugggggccaucgcgcucgacuucaagcccggcacgagcggguccccgaucgugaaccgcgagggcaagaucgucggccuguacgggaacggcguggugaccaccagcgggaccuacgucuccgccaucgcccaggccaaggccagccaggagggcccccugcccgagaucgaggacgagguguucaagaagcggaaccucacgaucauggaccugcacccggggagcggcaagacccgccgguaccugcccgcgaucgugcgcgaggccaucaagcggaagcuccgcacccugauccuggcccccacccgcgucguggccuccgagauggcggaggcccucaagggcaugcccauccgguaccagacgaccgccgucaagagcgagcacaccgggcgcgagaucgucgaccugaugugccacgccaccuucacgaugcggcugcucuccccggugcgcgugcccaacuacaacaugaucaucauggacgaggcccacuucaccgaccccgcgagcaucgccgcccggggcuacaucuccacccgcgucgggaugggcgaggccgccgcgaucuucaugaccgccacgcccccggggagcguggaggccuucccccaguccaacgccgugauccaggacgaggagcgggacauccccgagcgcagcuggaacuccggcuacgacuggaucaccgacuuccccggcaagaccgucugguucgugccgagcaucaaguccgggaacgacaucgccaacugccugcggaagaacggcaagcgcgugauccagcugagccggaagaccuucgacacggaguaccagaagaccaagaacaacgacugggacuacgucgugaccaccgacaucuccgagaugggggcgaacuuccgcgccgaccgggugaucgacccccgccggugccucaagcccgucauccugaaggacggccccgagcgcgugauccuggccgggccgaugcccgugacggucgccagcgcggcccagcggcgcggccggaucggccgcaaccagaacaaggagggggaccaguacaucuacaugggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugcgcggggaggcccggaagaccuucguggagcugaugcgccggggcgaccuccccgucuggcugagcuacaagguggccuccgagggcuuccaguacagcgaccgccgguggugcuucgacggggagcgcaacaaccaggugcuggaggagaacauggacgucgagaucuggacgaaggagggcgagcggaagaagcuccgcccccgguggcuggacgcccgcaccuacuccgacccgcuggcgcuccgggaguucaaggaguucgccgccgggcgccggagcgugagcggcgaccugauccuggagaucggcaagcucccccagcaccugacccugcgcgcccagaacgcccucgacaaccuggugaugcugcacaacuccgagcagggcgggaaggcguaccggcacgccauggaggagcuccccgacaccaucgagacccugaugcugcucgcccugaucgccguccugaccggcggggugacccucuucuuccugagcgggaaggggcugggcaagaccuccaucgggcuccugugcgugauggcgagcuccgcccugcucuggauggccagcgucgagccccacuggaucgccgccuccaucauccuggaguucuuccugauggugcuccugaucccggagcccgaccgccagcggacgccccaggacaaccagcuggcguacguggucaucggccuccuguucaugauccugacgguggccgccaacgagauggggcuccuggagaccaccaagaaggaccugggcaucgggcacguggccgccgagaaccaccaccacgcgaccaugcucgacgucgaccugcgcccggccagcgccuggacgcuguacgccguggccaccaccgugaucacccccaugaugcggcacacgaucgagaacaccaccgcgaacaucucccucaccgccaucgccaaccaggccgccauccugaugggccuggacaagggcuggcccaucagcaagauggacaucggggucccccuccuggcgcugggcugcuacucccaggugaacccgcucacgcugaccgccgccgugcugaugcucgucgcccacuacgcgaucaucgggcccggccugcaggccaaggccacccgcgaggcccagaagcgcaccgccgcggggaucaugaagaaccccacgguggacggcaucgugaccaucgaccuggaccccgucguguacgacgccaaguucgagaagcagcucggccagaucaugcugcugauccucugcaccagccagauccugcugaugcggaccacgugggcccucugcgaguccaucacccuggccaccgggccgcugaccacgcucugggagggcagccccgggaaguucuggaacaccaccaucgccguguccauggcgaacaucuuccgcggcagcuaccuggccggcgccgggcuggccuucucccucaugaagucccugggcgggggccggcgcgggaccggcgcccagggcgagacgcugggggagaaguggaagcggcagcucaaccagcuguccaagagcgaguucaacaccuacaagaaguccggcaucauggaggucgaccgcuccgaggcgaaggaggggcugaagcggggcgagaccaccaagcacgccgugagccgcgggacggccaagcugcggugguucguggagcgcaaccucgucaagcccgagggcaaggugaucgaccugggcugcgggcggggcgggugguccuacuacugcgccggccugaagaaggugaccgaggucaagggguacaccaagggcggccccgggcacgaggagccgauccccauggcgaccuacggcuggaaccucgugaagcugcacagcgggaaggacguguucuucacgccgcccgagaagugcgacacgcugcucugcgacaucggcgaguccagcccgaaccccaccaucgaggaggggcgcacccugcggguccugaagaugguggagcccuggcuccgcggcaaccaguucugcaucaagauccugaaccccuacaugccguccguggucgagacccuggagcagaugcagcggaagcacggcgggaugcucgugcgcaacccccugagccggaacuccacgcacgagauguacugggugagcugcggcaccgggaacaucgucuccgccgugaacaugaccagccgcaugcugcucaaccgguucaccauggcccaccgcaagcccacguacgagcgcgacguggaccugggcgccggcacccggcacgucgccguggagcccgagguggcgaaccuggacaucaucgggcagcgcaucgagaacaucaagaacgagcacaaguccaccuggcacuacgacgaggacaacccguacaagaccugggccuaccacggcagcuacgaggucaagcccuccgggagcgccuccagcauggugaacggcgugguccggcuccugacgaagcccugggacgugauccccauggucacccagaucgccaugaccgacaccacgccguucgggcagcagcgcguguucaaggagaagguggacacccggacgccccgggccaagcggggcaccgcgcagaucauggaggucacggccaaguggcuguggggcuuccucucccgcaacaagaagccccggaucugcacccgcgaggaguucacccggaaggugcgcagcaacgccgccaucggggccguguucgucgacgagaaccaguggaacagcgcgaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcucccgggcgaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgccgacgacacggccgggugggacacccggaucaccgaggacgaccugcagaacgaggcgaagaucaccgacaucauggagcccgagcacgcccuccuggccacgagcaucuucaagcugaccuaccagaacaaggugguccgcgugcagcgccccgccaaguccggcaccgugauggacgucaucagccggcgcgaccagcggggguccggccaggugggcaccuacgggcucaacacguucaccaacauggaggugcagcugauccgccagauggagagcgagggcaucuucucccccagcgagcuggagaccccgaaccucgccaagcggguccuggacuggcuggagaagcacgggguggagcgccucaagcggauggcgaucuccggcgacgacugcguggucaagcccaucgacgaccgcuucgccaccgcccugacggcccugaacgacauggggaaggugcggaaggacaucccccagugggagcccagcaagggcuggaacgacuggcagcaggucccguucugcucccaccacuuccaccagcucaucaugaaggacggccgcgagaucgucgugcccugccggaaccaggacgagcugguggggcgcgcccgggucagccagggcgcgggguggucccugcgcgagaccgccugccucggcaagagcuacgcccagauguggcagcugauguacuuccaccggcgcgaccugcggcucgccgccaacgcgaucugcagcgccgugcccguggacuggguccccaccucccgcaccaccuggagcauccacgcccaccaccaguggaugacgaccgaggacaugcuguccguguggaaccggguguggaucgaggagaacccguggauggaggacaagacccacgucagcuccugggaggaggugcccuaccuggggaagcgcgaggaccaguggugcggcagccucaucggccugaccgcccgcgcgacgugggccaccaacauccagguggccaucaaccagguccggcgccugaucgggaacgagaacuaccucgacuacaugaccuccaugaagcgguucaagaacgagagcgaccccgagggcgcccugugguga

SEQ ID NO: 7963 - RNA, 9879 nt, Artificial Sequence
  derived and/or modified CDS sequence (opt1) from DENV-1__FJ850077__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgccauggaccugggcgagcucugcgaggacaccaugaccuacaagugcccccggaucaccgagguggagcccgacgacguggacugcuggugcaacgccaccgacacgugggugaccuacgggaccugcagccagaccggcgagcaccggcgcgacaagcgguccgucgcccuggcgccccacgugggccuggggcucgagacccgcaccgagaccuggaugagcuccgagggcgccuggaagcagguccagaagguggagaccugggcgcugcggcaccccggguucacggugaucgcccuguuccucgcccacgccaucggcaccagcaucacccagaaggggaucaucuucauccugcugaugcucgugacccccuccauggcgaugcgcugcgucggcaucggcaaccgggacuucguggaggggcugagcggcgccacguggguggacgucgugcuggagcacggguccugcgugaccaccauggccaagaacaagcccacccucgacaucgagcugcugaagacggaggucaccaaccccgccgugcuccgcaagcugugcaucgaggccaagaucagcaacaccaccacggacucccggugcccgacccagggcgaggcgacccugguggaggagcaggacgccaacuucgucugccgccggaccuucguggaccgcggcugggggaacggcugcggccucuucggcaaggggagccugcugacgugcgccaaguucaagugcgugaccaagcucgagggcaagaucguccaguacgagaaccugaaguacuccgugaucgucaccgugcacaccggcgaccagcaccagguggggaacgagacgaccgagcacggcaccaucgccaccaucacgccccaggcccccacgagcgagauccagcugaccgacuacggggcgcucacccuggacugcagcccccggaccggccuggacuucaacgagaugguccuccugacgaugaaggagaaguccuggcuggugcacaagcagugguuccucgaccugccgcugcccuggaccuccggggccagcaccagccaggagaccuggaaccgccaggaccuccuggugacguucaagaccgcccacgccaagaagcaggaggucguggugcugggcucccaggagggcgccaugcacaccgcgcucaccggggccacggagauccagaccagcggcaccaccacgaucuucgccgggcaccugaagugccggcugaagauggacaagcucacccugaagggcauguccuacgucaugugcaccgggagcuucaagcuggagaaggagguggccgagacccagcacggcacggugcugguccaggugaaguacgagggcaccgacgcccccugcaagauccccuuccucacccaggacgagaagggggugacccagaacggccgccugaucacggcgaacccgaucgucaccgacaaggagaagcccgugaacaucgagaccgagccgcccuucggggaguccuacaucguggucggcgccggcgagaaggcccugaagcucagcugguucaagaagggguccagcaucggcaagauguucgaggccaccgcgcgcggggcccgccggauggccauccugggcgacacggccugggacuucggguccaucggcggccuguucaccagcguggggaagcucauccaccagguguucggcaccgccuacgggguccuguucuccggcgugagcuggaccaugaagaucgggaucggcauccugcucacguggcugggccugaacucccgcagcaccucccucagcaugaccugcaucgcgguggggauggucacccuguaccugggcgugauggugcaggccgacuccgggugcgucaucaacuggaagggccgcgagcucaagugcgggagcggcaucuucgugacgaacgaggugcacaccuggaccgagcaguacaaguuccaggccgacuccccgaagcggcugagcgccgccaucggcaaggcgugggaggagggggucugcggcauccgcagcgccacccggcuggagaacaucauguggaagcagaucuccaacgagcucaacuacauccugcuggagaacgacaugaaguucaccgugguggucggggacgccaacggcauccucacgcaggggaagaagaugauccgcccccagcccauggagcacaaguacagcuggaaguccuggggcaaggccaagaucaucggcgccgacauccagaacaccaccuucaucaucgacgggcccgacaccccggagugccccgacgaccagcgggcguggaacaucugggagguggaggacuacggcuucgggaucuucacgaccaacaucuggcugaagcugcgcgacagcuacacccagaugugcgaccaccggcucauguccgccgccaucaaggacagcaaggccgugcacgcggacaugggcuacuggaucgaguccgagaagaacgagaccuggaagcuggcccgcgccagcuucaucgaggucaagacgugcaucuggcccaagucccacacccuguggagcaacggcgugcucgaguccgagaugaucauccccaagaucuacgggggcccgaccagccagcacaacuaccggcccggguacuucacccagacggccggccccuggcaccuggggaagcuggagcucgacuucgaccugugcgagggcaccaccguggucguggacgagcacugcggcuaccgcgggccgucccugcggaccacgaccgugaccggcaagaucauccacgaguggugcugccgcagcugcacccugccgccccugcgguuccgcggggaggacggcugcugguacgggauggagauccggcccgucaaggagaaggaggagaaccuggugcgcuccauggugagcgccggcuccggcgaggucgacagcuucagccucgggauccugugcguguccauccugaucgaggaggugaugcggagccgcuggucccggaagaugcucaugacgggcacccuggcggucuuccugcuccugaucauggggcagcugaccuggaacgaccucauccgccugugcaucauggugggcgccaacgccagcgaccgcauggggaugggcaccacguaccuggcccucauggccaccuucaagaugcggccgauguucgccguggggcugcuguuccgcaagcucaccucccgggagguccugcugcucaccaucgggcugagccugguggccuccgucgagcuccccaacagccuggaggagcugggcgacgggcucgccaugggcaucaugaugcugaagcugcucacggacuuccagccccaccagcuguggaccacccugcucucccugaccuucauccgcacgagccugucccucgacuacgccuggaagaccauggccauggcgcugagcaucgugucccuguucccccucugccugagcaccaccucccagaagacgaccuggcugccggugcuccugggcagcuucgggugcaagccccugaccauguuccucaucaccgagaaccggaucuggggccgcaaguccuggcccaucaacgagggggucauggccgugggcaucgugagcauccugcuguccagccuccugaagaacgacgucccccuggccgggccgcucaucgccggcggcaugcugaucgcgugcuacgugaucagcggguccagcgccgaccugucccucgagaaggccgccgaggugagcugggaggaggaggccgagcacuccggcaccagccacaacauccuggucgaggugcaggacgacgggacgaugaagaucaaggacgaggagcgggacgacacccugaccauccuccugaaggcgacccugcucgccguguccggcgucuaccccaugagcauccccgccacgcuguucgugugguacuucuggcagaagaagaagcagcgcuccggggugcugugggacacccccagcccgcccgaggucgagcgggccgugcuggacgacggcaucuaccgcauccuccagcggggccugcuggggcgcucccaggugggcgucgggguguuccaggacggcguguuccacaccauguggcacgucacccgcggggccgugcucauguaccagggcaagcgccuggagcccagcugggcguccgugaagaaggaccugaucagcuacggcgggggcuggcgguuccagggguccuggaacacgggcgaggagguccaggugaucgccguggagcccgggaagaacccgaagaacguccagaccacccccggcaccuucaagacgcccgagggcgaggugggggccaucgcccucgacuucaagcccggcaccagcggguccccgaucgugaaccgcgagggcaagaucgucggccuguacgggaacggcguggugaccaccagcgggacguacgucuccgccaucgcgcaggccaaggccagccaggagggcccccugcccgagaucgaggacgagguguucaagaagcggaaccucaccaucauggaccugcacccggggagcggcaagacccgccgguaccugcccgccaucgugcgcgaggccaucaagcggaagcuccgcacccugauccuggcgcccacgcgcgucguggccuccgagauggccgaggcccucaagggcaugcccauccgguaccagaccaccgcggucaagagcgagcacaccgggcgcgagaucgucgaccugaugugccacgccacguucaccaugcggcugcucuccccggugcgcgugcccaacuacaacaugaucaucauggacgaggcccacuucaccgaccccgccagcaucgccgcgcggggcuacaucuccacccgcgucgggaugggcgaggccgccgccaucuucaugacggccacgccgcccgggagcguggaggcguucccccaguccaacgccgugauccaggacgaggagcgggacauccccgagcgcagcuggaacuccggcuacgacuggaucaccgacuuccccggcaagaccgucugguucgugcccagcaucaaguccgggaacgacaucgccaacugccugcggaagaacggcaagcgcgugauccagcugagccggaagacguucgacaccgaguaccagaagaccaagaacaacgacugggacuacgucgugaccacggacaucuccgagaugggggccaacuuccgcgccgaccgggugaucgacccccgccggugccucaagcccgucauccugaaggacggccccgagcgcgugauccuggcggggccgaugcccgucaccguggccagcgccgcccagcggcgcggccggaucggccgcaaccagaacaaggagggggaccaguacaucuacaugggccagccccucaacaacgacgaggaccacgcgcacuggaccgaggccaagaugcugcuggacaacaucaacacccccgaggggaucaucccggcccucuucgagcccgagcgcgagaaguccgccgccaucgacggcgaguaccggcugcgcggggaggcgcggaagacguucguggagcugaugcgccggggcgaccuccccgucuggcugagcuacaagguggccuccgagggcuuccaguacagcgaccgccgguggugcuucgacggggagcgcaacaaccaggugcuggaggagaacauggacgucgagaucuggaccaaggagggcgagcggaagaagcuccgcccccgguggcuggacgcccgcaccuacuccgacccgcuggcccuccgggaguucaaggaguucgccgcggggcgccggagcgugagcggcgaccugauccuggagaucggcaagcucccccagcaccugacccugcgcgcccagaacgcccucgacaaccuggugaugcugcacaacuccgagcagggcgggaaggccuaccggcacgccauggaggagcuccccgacaccaucgagacgcugaugcugcucgcgcugaucgccguccugaccgggggcgugacccucuucuuccugagcgggaagggccugggcaagaccuccaucgggcuccugugcgugauggccagcuccgcccugcucuggauggcgagcgucgagccccacuggaucgccgccuccaucauccuggaguucuuccugauggugcuccugaucccggagcccgaccgccagcggacgccccaggacaaccagcuggccuacguggucaucggccuccuguucaugauccugaccguggccgcgaacgagauggggcuccuggagaccaccaagaaggaccugggcaucgggcacguggccgccgagaaccaccaccacgccacgaugcucgacgucgaccugcgcccggccagcgcguggacccuguacgccguggccaccaccgugaucacgcccaugaugcggcacaccaucgagaacaccaccgccaacaucucccucacggccaucgcgaaccaggccgccauccugaugggccuggacaagggcuggcccaucagcaagauggacaucggggucccccuccuggcccugggcugcuacucccaggugaacccgcucacccugaccgccaccgugcugaugcucgucgcgcacuacgccaucaucgggcccggccugcaggccaaggccacgcgcgaggcgcagaagcgcaccgccgccgggaucaugaagaaccccaccguggacggcaucgugaccaucgaccuggaccccgucguguacgacgccaaguucgagaagcagcucggccagaucaugcugcugauccucugcacgagccagauccugcugaugcggaccaccugggcccucugcgaguccaucacccuggcgacggggccgcugaccacccucugggagggcagccccgggaaguucuggaacaccacgaucgccguguccauggccaacaucuuccgcggcagcuaccuggccggcgccgggcuggcguucucccucaugaagucccugggcgggggccggcgcgggaccggcgcccagggcgagacccugggggagaaguggaagcggcagcucaaccagcuguccaagagcgaguucaacaccuacaagaaguccggcaucauggaggucgaccgcuccgaggccaaggaggggcugaagcggggcgagacgaccaagcacgccgugagccgcgggaccgccaagcugcggugguucguggagcgcaaccucgucaagcccgagggcaaggugaucgaccugggcugcgggcggggcgggugguccuacuacugcgcgggccugaagaaggugaccgaggucaagggguacaccaagggcggccccgggcacgaggagccgauccccauggccacguacggcuggaaccucgugaagcugcacagcgggaaggacguguucuucacgccgcccgagaagugcgacacccugcucugcgacaucggcgaguccagcccgaaccccaccaucgaggaggggcgcacgcugcggguccugaagaugguggagcccuggcuccgcggcaaccaguucugcaucaagauccugaaccccuacaugccguccguggucgagacccuggagcagaugcagcggaagcacggcgggaugcucgugcgcaacccccugagccggaacuccacccacgagauguacugggugagcugcggcaccgggaacaucgucuccgccgugaacaugacgagccgcaugcugcucaaccgguucaccauggcccaccgcaagcccaccuacgagcgcgacguggaccugggcgcgggcacccggcacgucgccguggagcccgagguggccaaccuggacaucaucgggcagcgcaucgagaacaucaagaacgagcacaaguccacguggcacuacgacgaggacaacccguacaagaccugggccuaccacggcagcuacgaggucaagcccuccgggagcgccuccagcauggugaacggcgucgugcggcuccugaccaagcccugggacgugauccccauggucacccagaucgcgaugacggacaccaccccguucgggcagcagcgcguguucaaggagaagguggacacccggacgccccgcgccaagcggggcaccgcccagaucauggaggucaccgccaaguggcuguggggcuuccucucccgcaacaagaagccccggaucugcacccgcgaggaguucacgcggaaggugcgcagcaacgccgcgaucggggccguguucgucgacgagaaccaguggaacagcgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggcgaagggcucccgggccaucugguacauguggcugggcgcccgcuuccuggaguucgaggcccucggguucaugaacgaggaccacugguucagccgggagaacucccugagcggcguggagggggagggccugcacaagcucggguacauccugcgcgacaucuccaagaucccgggcggcaacauguacgcggacgacaccgccgggugggacacccggaucacggaggacgaccugcagaacgaggccaagaucaccgacaucauggagcccgagcacgcccuccuggccaccagcaucuucaagcugaccuaccagaacaaggugguccgcgugcagcgccccgcgaaguccggcacggugauggacgucaucagccggcgcgaccagcggggguccggccaggugggcaccuacgggcucaacaccuucaccaacauggaggugcagcugauccgccagauggagagcgagggcaucuucucccccagcgagcuggagacgccgaaccucgccaagcggguccuggacuggcuggagaagcacggggccgagcgccucaagcggauggccaucuccggcgacgacugcguggugaagcccaucgacgaccgcuucgccaccgcgcugaccgcccugaacgacauggggaagguccggaaggacaucccccagugggagcccagcaagggcuggaacgacuggcagcaggucccguucugcucccaccacuuccaccagcucaucaugaaggacggccgcgacaucgugguccccugccggaaccaggacgagcugguggggcgcgcccgggugagccagggcgccggguggucccugcgcgagaccgccugccucggcaagagcuacgcgcagauguggcagcugauguacuuccaccggcgcgaccugcggcucgccgccaacgccaucugcagcgccguccccguggacugggugcccaccucccgcacgaccuggagcauccacgcgcaccaccaguggaugaccaccgaggacaugcuguccgucuggaaccggguguggaucgaggagaacccguggauggaggacaagacgcacgugagcuccugggaggagguccccuaccuggggaagcgcgaggaccaguggugcggcagccucaucggccugaccgcccgcgccaccugggccaccaacauccagguggcgaucaaccaggugcggcgccugaucgggaacgagaacuaccucgacuacaugacguccaugaagcgguucaagaacgagagcgaccccgagggcgcccugugguga

SEQ ID NO: 7964 - RNA, 9879 nt, Artificial Sequence
  derived and/or modified CDS sequence (opt1) from DENV-1__FJ850081__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacccgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugcccgacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcgcgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgccaacggcauccucgcccaggggaagaagaugauccgcccccagcccauggagcacaaguacagcuggaaguccuggggcaaggcgaagaucaucggcgccgacauccagaacacgaccuucaucaucgacgggcccgacaccccggagugccccgacgaccagcgggccuggaacaucugggagguggaggacuacggcuucgggaucuucaccacgaacaucuggcugaagcugcgcgacagccacacccagaugugcgaccaccggcucauguccgccgcgaucaaggacagcaaggccguccacgccgacaugggcuacuggaucgaguccgagaagaacgagaccuggaagcuggcccgcgccagcuucaucgaggugaagaccugcaucuggcccaagucccacacgcuguggagcaacggcgugcucgaguccgagaugaucauccccaagaucuacgggggcccgaucagccagcacaacuaccggcccggguacuucacccagaccgcgggccccuggcaccuggggaagcuggagcucgacuucgaccugugcgagggcaccacggucgugguggacgagcacugcggcuaccgcgggccgucccugcggaccaccaccgucacgggcaagaucauccacgaguggugcugccgcagcugcacccugccgccccugcgguuccgcggggaggacggcugcugguacgggauggagauccggcccgugaaggagaaggaggagaaccuggugcgcuccauggucagcgccggcuccggcgagguggacagcuucagccucgggauccugugcguguccauccugaucgaggaggucaugcggagccgcuggucccggaagaugcucaugaccggcacccuggccguguuccugcuccugaucauggggcagcugacguggaacgaccucauccgccugugcaucauggugggcgccaacgccagcgaccgcauggggaugggcaccaccuaccuggcccucauggccaccuucaagaugcggccgauguucgccgucgggcugcuguuccgccggcucacgucccgcgaggugcugcugcucaccaucgggcugagccugguggccuccgucgagcuccccaacagccuggaggagcugggcgacgggcucgccaugggcaucaugaugcugaagcugcucaccgacuuccagccccaccagcuguggaccacgcugcucucccugaccuucauccggaccagccugucccucgacuacgcguggaagaccauggccauggcccugagcaucgugucccuguucccccucugccugagcacgaccucccagaagaccaccuggcugccgguccuccugggcagcuucgggugcaagccccugacgauguuccucaucaccgagaacaagaucuggggccgcaaguccuggcccaucaacgaggggaucauggccgugggcaucgugagcauccugcuguccagccuccugaagaacgacgucccccuggcggggccgcucaucgccggcggcaugcugaucgccugcuacgugaucagcggguccagcgccgaccugucccucgagaaggccgcggaggugagcugggaggaggaggccgagcacuccggcaccagccacaacauccuggucgaggugcaggacgacgggaccaugaagaucaaggacgaggagcgggacgacacccugacgauccuccugaaggccacccugcucgccguguccggcgucuaccccaugagcauccccgccacccuguucgugugguacuucuggcagaagaagaagcagcgcuccggggugcugugggacacccccagcccgcccgaggucgagcgggcggugcuggacgacggcaucuaccgcauccuccagcggggccugcuggggcgcucccaggugggcgucgggguguuccaggacggcguguuccacacgauguggcacgucacccgcggggccgugcucauguaccagggcaagcgccuggagcccagcugggccuccgugaagaaggaccugaucagcuacggcgggggcuggcgguuccagggguccuggaacaccggcgaggagguccaggugaucgccguggagcccgggaagaacccgaagaacguccagaccacgcccggcaccuucaagacccccgagggcgaggugggggccaucgcgcucgacuucaagcccggcaccagcggguccccgaucgugaaccgcgagggcaagaucgucggccuguacgggaacggcguggugacgaccagcgggaccuacgucuccgccaucgcccaggccaaggccagccaggagggcccccugcccgagaucgaggacgagguguucaagaagcggaaccucaccaucauggaccugcacccggggagcggcaagacgcgccgguaccugcccgcgaucgugcgcgaggccaucaagcggaagcuccgcacccugauccuggcccccacccgcgucguggccuccgagauggcggaggcccucaagggcaugcccauccgguaccagaccacggccgucaagagcgagcacaccgggcgcgagaucgucgaccugaugugccacgccaccuucaccaugcggcugcucuccccggugcgcgugcccaacuacaacaugaucaucauggacgaggcccacuucacggaccccgcgagcaucgccgcccggggcuacaucuccacccgcgucgggaugggcgaggccgccgcgaucuucaugaccgccacgccgcccgggagcgccgaggccuucccccaguccaacgccgugauccaggacgaggagcgggacauccccgagcgcagcuggaacuccggcuacgacuggaucacggacuuccccggcaagaccgugugguucguccccagcaucaaguccgggaacgacaucgcgaacugccugcggaagaacggcaagcgcgugauccagcugagccggaagaccuucgacaccgaguaccagaagacgaagaacaacgacugggacuacguggucaccaccgacaucuccgagaugggggccaacuuccgcgccgaccgggugaucgacccccgccggugccucaagcccgugauccugaaggacggccccgagcgcgucauccuggccgggccgaugcccgugaccguggcgagcgccgcccagcggcgcggccggaucggccgcaaccagaacaaggagggggaccaguacaucuacaugggccagccccucaacaacgacgaggaccacgcccacuggacggaggccaagaugcugcuggacaacaucaacacccccgaggggaucaucccggcccucuucgagcccgagcgcgagaaguccgccgccaucgacggcgaguaccggcugcgcggggaggcccggaagaccuucgucgagcugaugcgccggggcgaccuccccguguggcugagcuacaaggucgccuccgagggcuuccaguacagcgaccgccgguggugcuucgacggggagcgcaacaaccaggugcuggaggagaacauggacguggagaucuggaccaaggagggcgagcggaagaagcuccgcccccgguggcuggacgcgcgcacguacuccgacccgcuggcccuccgggaguucaaggaguucgccgccgggcgccggagcgucagcggcgaccugauccuggagaucggcaagcucccccagcaccugacccugcgcgcccagaacgcgcucgacaaccuggugaugcugcacaacuccgagcagggcgggaaggccuaccggcacgccauggaggagcuccccgacaccaucgagacccugaugcugcucgcccugaucgcggugcugaccgggggcgucacccucuucuuccugagcgggaagggccugggcaagaccuccaucgggcuccugugcgugauggccagcuccgcccugcucuggauggccagcguggagccccacuggaucgccgcguccaucauccuggaguucuuccugaugguccuccugaucccggagcccgaccgccagcggacgccccaggacaaccagcuggccuacguggugaucggccuccuguucaugauccugaccgucgccgccaacgagauggggcuccuggagacgaccaagaaggaccugggcaucgggcacguggccgcggagaaccaccaccacgccaccaugcucgacguggaccugcgcccggccagcgccuggacccuguacgccgucgcgacgaccgugaucacccccaugaugcggcacaccaucgagaacacgaccgccaacaucucccucaccgccaucgccaaccaggccgcgauccugaugggccuggacaagggcuggcccaucagcaagauggacaucggggugccccuccuggcccugggcugcuacucccaggucaacccgcucacccugacggccgccgugcugaugcucguggcgcacuacgccaucaucgggcccggccugcaggccaaggccacccgcgaggcccagaagcgcaccgcggccgggaucaugaagaaccccaccgucgacggcaucgugacgaucgaccuggaccccguggucuacgacgccaaguucgagaagcagcucggccagaucaugcugcugauccucugcaccagccagauccugcugaugcggaccaccugggcccucugcgaguccaucacgcuggccaccgggccgcugaccacccucugggagggcagccccgggaaguucuggaacacgaccaucgcgguguccauggccaacaucuuccgcggcagcuaccuggccggcgccgggcuggccuucucccucaugaagucccugggcgggggccggcgcgggaccggcgcgcagggcgagacccugggggagaaguggaagcggcagcucaaccagcuguccaagagcgaguucaacacguacaagaaguccggcaucauggagguggaccgcuccgaggccaaggaggggcugaagcggggcgagaccaccaagcacgccgucagccgcgggaccgccaagcugcggugguucguggagcgcaaccucgugaagcccgagggcaaggucaucgaccugggcugcgggcggggcgggugguccuacuacugcgcgggccugaagaaggugacggaggugaagggguacaccaagggcggccccgggcacgaggagccgauccccauggccaccuacggcuggaaccucgucaagcugcacagcgggaaggacguguucuucacgccgcccgagaagugcgacacccugcucugcgacaucggcgaguccagcccgaaccccacgaucgaggaggggcgcacccugcgggugcugaagauggucgagcccuggcuccgcggcaaccaguucugcaucaagauccugaaccccuacaugccguccgugguggagacccuggagcagaugcagcggaagcacggcgggaugcucguccgcaacccccugagccggaacuccacccacgagauguacugggugagcugcggcacggggaacaucguguccgccgucaacaugaccagccgcaugcugcucaaccgguucaccauggcccaccgcaagcccaccuacgagcgcgacguggaccugggcgccggcacgcggcacguggcggucgagcccgagguggccaaccuggacaucaucgggcagcgcaucgagaacaucaagaacgagcacaaguccaccuggcacuacgacgaggacaacccguacaagaccugggccuaccacggcagcuacgaggugaagcccuccgggagcgccuccagcauggucaacggcguggugcggcuccugaccaagcccugggacgucauccccauggugacgcagaucgccaugaccgacaccaccccguucgggcagcagcgcgucuucaaggagaagguggacacgcggacgccccgggcgaagcggggcaccgcccagaucauggaggugaccgccaaguggcuguggggcuuccucucccgcaacaagaagccccggaucugcacgcgcgaggaguucacccggaagguccgcagcaacgccgccaucggggcgguguucguggacgagaaccaguggaacagcgccaaggaggccgucgaggacgagcgguucugggaccuggugcaccgcgagcgggagcugcacaagcagggcaagugcgcgaccugcguguacaacaugauggggaagcgcgagaagaagcucggcgaguucgggaaggcgaagggcucccgggccaucugguacauguggcugggcgcccgcuuccuggaguucgaggcccucggguucaugaacgaggaccacugguucagccgggagaacucccugagcggcgucgagggggagggccugcacaagcucggguacauccugcgcgacaucuccaagaucccgggcggcaacauguacgccgacgacaccgcggggugggacacgcggaucaccgaggacgaccugcagaacgaggccaagaucaccgacaucauggagcccgagcacgcccuccuggccaccagcaucuucaagcugacguaccagaacaagguggugcgcguccagcgccccgccaaguccggcaccgugauggacgugaucagccggcgcgaccagcggggguccggccaggucggcaccuacgggcucaacaccuucacgaacauggaggugcagcugauccgccagauggagagcgagggcaucuucucccccagcgagcuggagaccccgaaccucgcgaagcgggugcuggacuggcuggagaagcacggggccgagcgccucaagcggauggccaucuccggcgacgacugcgucgugaagcccaucgacgaccgcuucgccaccgcccugaccgcgcugaacgacauggggaaggugcggaaggacaucccccagugggagcccagcaagggcuggaacgacuggcagcaggucccguucugcucccaccacuuccaccagcucaucaugaaggacggccgcgagaucguggugcccugccggaaccaggacgagcuggucgggcgcgcccgggugagccagggcgccggguggucccugcgcgagacggccugccucggcaagagcuacgcccagauguggcagcugauguacuuccaccggcgcgaccugcggcucgcggccaacgccaucugcagcgccgugcccgucgacugggugcccaccucccgcaccaccuggagcauccacgcgcaccaccaguggaugaccacggaggacaugcuguccguguggaaccgggucuggaucgaggagaacccguggauggaggacaagacccacgugagcuccugggaggaggugcccuaccuggggaagcgcgaggaccaguggugcggcagccucaucggccugaccgcccgcgccaccugggccacgaacauccaggucgccaucaaccaggugcggcgccugaucgggaacgagaacuaccucgacuacaugaccuccaugaagcgguucaagaacgagagcgaccccgagggcgcgcugugguga

SEQ ID NO: 7965 - RNA, 9879 nt, Artificial Sequence
  derived and/or modified CDS sequence (opt1) from DENV-1__FJ850084__SS-prME
agcgugaccaugcugcucaugcugcugcccaccgcccucgccuuccaccugaccacccggggcggggagccccacaugaucgugagcaagcaggagcggggcaagagccuccuguucaagaccagcgugggggugaacaugugcacccugaucgcgauggaccugggcgagcucugcgaggacaccaugaccuacaagugcccccgcaucaccgagguggagcccgacgacguggacugcuggugcaacgccaccgacaccugggugaccuacgggaccugcagccagaccggcgagcaccggcgcgacaagcgguccgucgcccuggcgccccacgugggccuggggcucgagacgcgcaccgagaccuggaugagcuccgagggcgccuggaagcagauccagaagguggagaccugggcgcugcggcaccccggguucacggucaucgcccuguuccucgcccacgccaucggcaccagcaucacccagaaggggaucaucuucauccugcugaugcucgugacccccuccauggcgaugcgcugcgugggcaucggcaaccgggacuucgucgaggggcugagcggcgccacguggguggacgugguccuggagcacggguccugcgugaccaccauggccaagaacaagcccacccucgacaucgagcugcugaagacggaggugaccaaccccgccguccuccgcaagcugugcaucgaggccaagaucagcaacaccaccacggacucccggugcccgacccagggcgaggcgacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccguccacaccggcgaccagcaccagguggggaacgagacgaccgagcacggcaccaucgccaccaucacgccccaggcccccacgagcgagauccagcugaccgacuacggggcgcucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgccaagaagcaggagguggucgugcugggcucccaggagggcgccaugcacaccgcgcucaccggggccacggagauccagaccagcggcaccaccacgaucuucgccgggcaccugaagugccggcugaagauggacaagcucacccugaagggcauguccuacgugaugugcaccgggagcuucaagcuggagaaggaggucgccgagacccagcacggcacggugcuggugcaggucaaguacgagggcaccgacgcccccugcaagauccccuuccucacccaggacgagaagggggugacccagaacggccgccugaucacggcgaacccgaucgugaccgacaaggagaagcccgucaacaucgagaccgagccgcccuucggggaguccuacaucguggugggcgccggcgagaaggcccugaagcucagcugguucaagaagggguccagcaucggcaagauguucgaggccaccgcgcgcggggcccgccggauggccauccugggcgacacggccugggacuucggguccaucggcggccuguucaccagcgucgggaagcucauccaccagguguucggcgccgcguacggggugcuguucuccggcgucagcuggaccaugaagaucgggaucggcauccugcucaccuggcugggccugaacucccgcagcacgucccucagcaugaccugcaucgccguggggauggugacccuguaccugggcgucauggugcaggccgacuccgggugcgugaucaacuggaagggccgcgagcucaagugcgggagcggcaucuucgucaccaacgaggugcacacguggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccgucguggugggggacgccaacggcauccucacccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagcuacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagaugaucauccccaagaucuacgggggcccgaccagccagcacaacuaccggcccggguacuucacccagaccgccggccccuggcaccuggggaagcuggagcucgacuucgaccugugcgagggcacgaccgugguggucgacgagcacugcggcuaccgcgggccgucccugcggaccaccacggugaccggcaagaucauccacgaguggugcugccgcagcugcacccugccgccccugcgguuccgcggggaggacggcugcugguacgggauggagauccggcccgugaaggagaaggaggagaaccugguccgcuccauggugagcgcgggcuccgccgagguggacagcuucagccucggcauccugugcgucuccauccugaucgaggaggugaugcggagccgcuggucccggaagaugcucaugaccgggacgcuggccguguuccugcuccugaucaugggccagcugaccuggaacgaccucauccgccugugcaucauggucggggccaacgccagcgaccgcaugggcauggggaccaccuaccuggcccucauggccacguucaagaugcggccgauguucgccguggggcugcuguuccgcaagcucaccucccgggaggugcugcugcucaccaucggccugagccuggucgccuccguggagcuccccaacagccuggaggagcugggggacggccucgccauggggaucaugaugcugaagcugcucaccgacuuccagccccaccagcuguggacgacccugcucucccugaccuucauccgcaccagccugucccucgacuacgcguggaagacgauggccauggcccugagcaucgucucccuguucccccucugccugagcaccaccucccagaagaccacguggcugccggugcuccugggcagcuucggcugcaagccccugaccauguuccucaucaccgagaacaagaucugggggcggaaguccuggcccaucaacgagggcaucauggccguggggaucgucagcauccugcuguccagccuccugaagaacgacgugccccuggcgggcccgcucaucgccgggggcaugcugaucgccugcuacgugaucagcggcuccagcgccgaccugucccucgagaaggccgcggaggucagcugggaggaggaggccgagcacuccgggaccagccacaacauccugguggaggugcaggacgacggcaccaugaagaucaaggacgaggagcgcgacgacacgcugaccauccuccugaaggccacccugcucgccgucuccgggguguaccccaugagcauccccgccacccuguucgugugguacuucuggcagaagaagaagcagcgguccggcguccugugggacacgcccagcccgcccgagguggagcgcgcggugcuggacgacgggaucuaccggauccuccagcgcggccugcugggccggucccaggucggggugggcguguuccaggacggggucuuccacaccauguggcacgugacccgcggcgccgugcucauguaccaggggaagcggcuggagcccagcugggccuccgucaagaaggaccugaucagcuacggcggcggguggcgcuuccagggcuccuggaacaccggggaggagguccaggugaucgccgucgagcccggcaagaacccgaagaacgugcagacgacccccgggaccuucaagacccccgagggcgaggugggcgccaucgcgcucgacuucaagcccgggacgagcggcuccccgaucgucaaccgggaggggaagaucgugggccuguacggcaacgggguggucaccaccagcggcaccuacguguccgccaucgcccaggccaaggccagccaggaggggccccugcccgagaucgaggacgagguguucaagaagcgcaaccucacgaucauggaccugcacccgggcagcgggaagacccggcgcuaccugcccgcgaucguccgggaggccaucaagcgcaagcuccggacccugauccuggcccccacccgcgugguggccuccgagauggcggaggcccucaagggcaugcccauccgcuaccagacgaccgccgucaagagcgagcacaccggccgggagaucguggaccugaugugccacgccaccuucacgaugcgccugcucuccccggugcggguccccaacuacaacaugaucaucauggacgaggcccacuucaccgaccccgcgagcaucgccgcccgcggguacaucuccacccgggugggcaugggggaggccgccgcgaucuucaugaccgccacgcccccgggcagcguggaggccuucccccaguccaacgccgucauccaggacgaggagcgcgacauccccgagcggagcuggaacuccggguacgacuggaucaccgacuuccccggcaagaccgugugguucgugccgagcaucaaguccggcaacgacaucgccaacugccugcgcaagaacgggaagcgggucauccagcugagccgcaagaccuucgacacggaguaccagaagaccaagaacaacgacugggacuacguggugaccaccgacaucuccgagaugggcgcgaacuuccgggccgaccgcgucaucgacccccggcgcugccucaagcccgugauccugaaggacgggcccgagcgggugauccuggccggcccgaugcccgucacgguggccagcgcggcccagcgccgggggcgcaucggccggaaccagaacaaggagggcgaccaguacaucuacauggggcagccccucaacaacgacgaggaccacgcccacuggaccgaggccaagaugcugcuggacaacaucaacacccccgagggcaucaucccggcccucuucgagcccgagcgcgagaaguccgcggccaucgacggggaguaccgccugcggggcgaggcccgcaagaccuucgucgagcugaugcggcgcggggaccuccccguguggcugagcuacaagguggccuccgagggcuuccaguacagcgaccggcgcuggugcuucgacggcgagcggaacaaccagguccuggaggagaacauggacguggagaucuggacgaaggagggggagcgcaagaagcuccggccccgcuggcuggacgcccggaccuacuccgacccgcuggcgcuccgcgaguucaaggaguucgccgccggccggcgcagcgugagcggggaccugauccuggagaucggcaagcucccccagcaccugacccugcgggcccagaacgcccucgacaaccuggucaugcugcacaacuccgagcagggcgggaaggcguaccgccacgccauggaggagcuccccgacaccaucgagacccugaugcugcucgcccugaucgccgugcugacgggcggggugacccucuucuuccugagcggcaaggggcugggcaagaccuccaucggccuccugugcgucauggcgagcuccgcccugcucuggauggccagcguggagccccacuggaucgccgccuccaucauccuggaguucuuccugauggugcuccugaucccggagcccgaccggcagcgcacgccccaggacaaccagcuggcguacgucgugaucgggcuccuguucaugauccugacgguggccgccaacgagaugggccuccuggagaccaccaagaaggaccuggggaucggccacgucgccgccgagaaccaccaccacgcgaccaugcucgacguggaccugcggccggccagcgccuggacgcuguacgccguggccaccaccgucaucacccccaugaugcgccacacgaucgagaacaccaccgcgaacaucucccucaccgccaucgccaaccaggccgccauccugauggggcuggacaagggcuggcccaucagcaagauggacaucggcgugccccuccuggcgcuggggugcuacucccaggugaacccgcucacgcugaccgccaccguccugaugcucguggcccacuacgccaucaucggccccgggcugcaggcgaaggccacccgggaggcccagaagcgcacggccgccggcaucaugaagaaccccaccguggacgggaucgucaccaucgaccuggaccccgugguguacgacgcgaaguucgagaagcagcucggccagaucaugcugcugauccucugcaccagccagauccugcugaugcgcacgaccugggcccucugcgaguccaucacccuggccaccggcccgcugacgacccucugggaggggagccccggcaaguucuggaacaccaccaucgccgucuccauggccaacaucuuccgggggagcuaccuggcgggcgccggccuggccuucucccucaugaagucccucgggggcgggcgccgggggacgggggcccagggcgagacccugggcgagaaguggaagcgccagcucaaccagcuguccaagagcgaguucaacaccuacaagaaguccgggaucauggagguggaccgguccgaggccaaggagggccugaagcgcggggagaccacgaagcacgcggugagccggggcaccgccaagcugcgcugguucgucgagcggaaccucgugaagcccgaggggaaggugaucgaccugggcugcggccgcgggggcugguccuacuacugcgccgggcugaagaaggucaccgaggugaagggcuacaccaagggcgggcccggccacgaggagccgauccccauggccaccuacggguggaaccucgugaagcugcacagcggcaaggacgucuucuucacgccgcccgagaagugcgacacccugcucugcgacaucggggaguccagcccgaaccccaccaucgaggagggccggacccugcgcgugcugaagaugguggagcccuggcuccgggggaaccaguucugcaucaagauccugaaccccuacaugccguccgucguggagacgcuggagcagaugcagcgcaagcacggcggcaugcucgugcggaacccccugagccgcaacuccacccacgagauguacugggucagcugcgggaccggcaacaucguguccgcggugaacaugaccagccggaugcugcucaaccgcuucacgauggcccaccggaagcccaccuacgagcgcgacgucgaccugggggccggcacccgccacguggccguggagcccgaggucgccaaccuggacaucaucggccagcggaucgagaacaucaagaacgagcacaaguccaccuggcacuacgacgaggacaacccguacaagacgugggcguaccacgggagcuacgaggugaagcccuccggcagcgccuccagcauggugaacggggucgugcgccuccugaccaagcccugggacgucauccccauggugacccagaucgccaugaccgacacgaccccguucggccagcagcggguguucaaggagaaggucgacacccgcacgccccgggccaagcgcgggacggcccagaucauggaggugaccgcgaaguggcuguggggcuuccucucccggaacaagaagccccgcaucugcacccgggaggaguucacccgcaaggugcggagcaacgccgccaucggcgccgucuucguggacgagaaccaguggaacagcgccaaggaggcgguggaggacgagcgcuucugggaccugguccaccgggagcgcgagcugcacaagcaggggaagugcgccacgugcguguacaacaugaugggcaagcgggagaagaagcucggggaguucggcaaggccaaggggucccgcgccaucugguacauguggcugggcgcgcgguuccuggaguucgaggcccucggcuucaugaacgaggaccacugguucagccgcgagaacucccugagcgggguggagggcgaggggcugcacaagcucggcuacauccugcgggacaucuccaagauccccggcgggaacauguacgccgacgacaccgccgggugggacacccgcaucaccgaggacgaccugcagaacgaggccaagaucacggacaucauggagcccgagcacgcgcuccuggccaccagcaucuucaagcugaccuaccagaacaaggucgugcgggugcagcgccccgccaaguccgggaccgucauggacgugaucagccgccgggaccagcgcggcuccggccaggugggcacguacggccucaacaccuucaccaacauggagguccagcugauccggcagauggagagcgaggggaucuucucccccagcgagcuggagaccccgaaccucgccaagcgcgugcuggacuggcuggagaagcacggcgccgagcggcucaagcgcauggcgaucuccggggacgacugcguggucaagcccaucgacgaccgguucgccacggcccugaccgcccugaacgacaugggcaaggugcgcaaggacaucccccagugggagcccagcaagggguggaacgacuggcagcaggucccguucugcucccaccacuuccaccagcucaucaugaaggacggccgggacaucgucgugcccugccgcaaccaggacgagcuggugggccgggcccgcgucagccagggggcgggcuggucccugcgggagaccgccugccucggcaagagcuacgcccagauguggcagcugauguacuuccaccgccgggaccugcgccucgccgccaacgcgaucugcagcgccgugcccguggacuggguccccaccucccggaccacguggagcauccacgcccaccaccaguggaugaccaccgaggacaugcuguccguguggaaccgcguguggaucgaggagaacccguggauggaggacaagacccacgucagcuccugggaggaggugcccuaccugggcaagcgggaggaccaguggugcgggagccucaucggccugacggcccgcgcgaccugggccaccaacauccagguggccaucaaccagguccgccggcugaucggcaacgagaacuaccucgacuacaugaccuccaugaagcgcuucaagaacgagagcgaccccgagggggcccugugguga

SEQ ID NO: 7966 - RNA, 9879 nt, Artificial Sequence
  derived and/or modified CDS sequence (opt1) from DENV-1__FJ850087__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgcguggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacgugaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggaggucgaggacuacggcuucgggaucuucaccacgaacaucuggcugaagcugcgcgacagccacacccagaugugcgaccaccggcucauguccgccgccaucaaggacagcaaggcggugcacgccgacaugggcuacuggaucgaguccgagaagaacgagaccuggaagcuggcccgcgccagcuucaucgaggugaagaccugcaucuggcccaagucccacacgcuguggagcaacggcguccucgaguccgagauggugauccccaagaucuacgggggcccgaucagccagcacaacuaccggcccggguacuucacccagaccgccggccccuggcaccuggggaagcuggagcucgacuucgaccugugcgagggcaccacgguggucguggacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgucaaggagaaggaggagaaccuggugcgcuccauggugagcgcgggcuccggcgaggucgacagcuucagccucgggauccugugcguguccauccugaucgaggaggugaugcggagccgcuggucccggaagaugcucaugaccggcacccuggucguguuccugcuccugaucauggggcagcugacguggaacgaccucauccgccugugcaucauggugggcgccaacgccagcgaccgcauggggaugggcaccaccuaccuggcccucauggccaccuucaagaugcggccgauguucgcggucggccugcuguuccgccggcucacgucccgcgaggugcugcugcucaccgucgggcugagccugguggccuccguggagcuccccaacagccuggaggagcugggcgacgggcucgccaugggcaucaugaugcugaagcugcucaccgacuuccagccccaccagcuguggaccacgcugcucucccugaccuucauccggaccagccugucccucgacuacgccuggaagaccauggccauggcgcugagcaucgucucccuguucccccucugccugagcacgaccucccagaagaccaccuggcugccggugcuccugggcagcuucgggugcaagccccugacgauguuccucaucaccgagaacaagaucuggggccgcaaguccuggcccaucaacgaggggaucauggccgugggcaucgucagcauccugcuguccagccuccugaagaacgacgugccccuggccgggccgcucaucgccggcggcaugcugaucgcgugcuacgugaucagcggguccagcgccgaccugucccucgagaaggccgccgaggucagcugggaggaggaggccgagcacuccggcaccagccacaacauccugguggaggugcaggacgacgggaccaugaagaucaaggacgaggagcgggacgacacccugacgauccuccugaaggcgacccugcucgccgucuccggcguguaccccaugagcauccccgccacccuguucgugugguacuucuggcagaagaagaagcagcgcuccgggguccugugggacacccccagcccgcccgagguggagcgggccgugcuggacgacggcaucuaccgcauccuccagcggggccugcuggggcgcucccaggucggcgugggggugcuccaggacggcgucuuccacacgauguggcacgugacccgcggggccgugcugauguaccagggcaagcgccuggagcccagcugggcguccgucaagaaggaccucaucagcuacggcgggggcuggcgguuccagggguccuggaacaccggcgaggagguccaggugaucgccgucgagcccgggaagaacccgaagaacgugcagaccacgcccggcaccuucaagacccccgagggcgaggugggggccaucgcccuggacuucaagcccggcaccagcggguccccgaucgucaaccgcgagggcaagaucgugggccuguacgggaacggcguggucacgaccagcgggaccuacguguccgccaucgcgcaggccaaggccacccaggagggcccccuccccgagaucgaggacgagguguucaagaagcggaaccugacgaucauggaccugcacccggggagcggcaagacccgccgguaccuccccgccaucguccgcgaggccaucaagcggaagcugcgcacccugauccucgcgcccacccgcgugguggccagcgagauggccgaggcccugaagggcaugcccauccgguaccagacgaccgcggucaaguccgagcacaccgggcgcgagaucguggaccugaugugccacgccaccuucacgaugcggcuccugagcccggugcgcguccccaacuacaacaugaucaucauggacgaggcccacuucaccgaccccgccuccaucgccgcgcggggcuacaucagcacccgcguggggaugggcgaggccgccgccaucuucaugaccgccacgcccccgggguccguggaggcguucccccagagcaacgccgucauccaggacgaggagcgggacauccccgagcgcuccuggaacagcggcuacgacuggaucaccgacuuccccggcaagaccgugugguucgugccguccaucaagagcgggaacgacaucgccaacugccugcggaagaacggcaagcgcgucauccagcucucccggaagaccuucgacacggaguaccagaagaccaagaacaacgacugggacuacguggugaccaccgacaucagcgagaugggggccaacuuccgcgccgaccgggucaucgacccccgccggugccugaagcccgugauccugaaggagggccccgagcgcgucauccucgcggggccgaugcccgugacgguggccuccgccgcccagcggcgcggccggaucggccgcaaccagaacaaggagggggaccaguacaucuacaugggccagccccugaacaacgacgaggaccacgcgcacuggaccgaggccaagaugcugcucgacaacaucaacacccccgaggggaucaucccggcccuguucgagcccgagcgcgagaaguccgccgccaucgacggcgaguaccggcugcgcggggaggcgcggaagaccuucgucgagcucaugcgccggggcgaccugcccguguggcuguccuacaagguggccagcgagggcuuccaguacuccgaccgccgguggugcuucgacggggagcgcaacaaccagguccucgaggagaacauggacguggagaucuggacgaaggagggcgagcggaagaagcugcgcccccgguggcuggacgcccgcaccuacagcgacccgcucgcccugcgggaguucaaggaguucgccgcggggcgccgguccgugagcggcgaccugauccucgagaucggcaagcugccccagcaccugacccuccgcgcccagaacgcccuggacaaccuggucaugcuccacaacagcgagcagggcgggaaggccuaccggcacgccauggaggagcugcccgacaccaucgagacccugaugcuccuggcgcugaucgccgugcucaccggcggggugacccuguucuuccuguccgggaaggggcucggcaagaccagcaucgggcugcugugcgucauggccuccagcgcccuccuguggauggcguccguggagccccacuggaucgccgccagcaucauccuggaguucuuccucauggugcugcugaucccggagcccgaccgccagcggacgccccaggacaaccagcucgccuacgucgugaucggccugcuguucaugauccucacgguggccgcgaacgagauggggcugcuggagaccaccaagaaggaccucggcaucgggcacgucgccguggagaaccaccaccacgccaccaugcuggacguggaccugcgcccggccuccgccuggacgcucuacgcggucgccaccaccgugaucacccccaugaugcggcacacgaucgagaacaccaccgccaacaucagccugaccgccaucgccaaccaggcggccauccugaugggccucgacaagggcuggcccaucuccaagauggacaucggggugccccugcuggcccucggcugcuacagccaggucaacccgcugacgcugaccgccgccgugcucaugcugguggcgcacuacgccaucaucgggcccggccugcaggccaaggccacccgcgaggcgcagaagcgcaccgccgccgggaucaugaagaaccccacggucgacggcaucgugaccaucgaccucgaccccguggucuacgacgccaaguucgagaagcagcugggccagaucaugcugcucauccugugcaccucccagauccugcucaugcggaccacgugggcccugugcgagagcaucacccuggcgaccgggccgcucaccacgcugugggagggcucccccgggaaguucuggaacaccaccaucgccgugagcauggccaacaucuuccgcggcuccuaccuggccggcgccgggcucgcguucagccugaugaagucccugggcgggggccggcgcgggaccggcgcccagggcgagacgcucggggagaaguggaagcggcagcugaaccagcugagcaaguccgaguucaacaccuacaagaaguccggcaucauggagguggaccgcagcgaggccaaggaggggcugaagcggggcgagaccaccaagcacgccgucucccgcgggacggccaagcuccggugguucguggagcgcaaccuggugaagcccgagggcaaggucaucgaccugggcugcgggcggggcggguggagcuacuacugcgcgggccucaagaaggugaccgaggugaagggguacaccaagggcggccccgggcacgaggagccgauccccauggccaccuacggcuggaaccuggucaagcugcacuccgggaaggacguguucuucacgccgcccgagaagugcgacacgcuccugugcgacaucggcgagagcuccccgaaccccaccaucgaggaggggcgcacccugcgggugcucaagauggucgagcccuggcugcgcggcaaccaguucugcaucaagauccugaaccccuacaugccgagcgugguggagacccucgagcagaugcagcggaagcacggcgggaugcugguccgcaacccccugucccggaacagcacgcacgagauguacuggguguccugcggcaccgggaacaucgugagcgccgucaacaugaccucccgcaugcuccugaaccgguucaccauggcccaccgcaagcccacguacgagcgcgacguggaccugggcgcgggcacccggcacguggccgucgagcccgagguggccaaccucgacaucaucgggcagcgcaucgagaacaucaagaacgagcacaagagcaccuggcacuacgacgaggacaacccguacaagaccugggccuaccacggcuccuacgaggucaagcccagcggguccgccagcuccauggugaacggcgugguccggcugcugacgaagcccugggacgugauccccauggugacccagaucgcgaugaccgacaccacgccguucgggcagcagcgcgucuucaaggagaagguggacacccggacgccccgggccaagcggggcaccgcccagaucauggaggugacggccaaguggcucuggggcuuccugagccgcaacaagaagccccggaucugcacccgcgaggaguucacccggaagguccgcuccaacgccgcgaucggggccguguucguggacgagaaccaguggaacagcgccaaggaggccgucgaggacgagcgguucugggaccuggugcaccgcgagcgggagcuccacaagcagggcaagugcgcgaccugcguguacaacaugauggggaagcgcgagaagaagcugggcgaguucgggaaggcgaagggcagccgggccaucugguacauguggcugggcgcccgcuuccucgaguucgaggcccugggguucaugaacgaggaccacugguucucccgggagaacagccuguccggcgucgagggggagggccuccacaagcugggguacauccugcgcgacaucagcaagaucccgggcggcaacauguacgcggacgacacggccgggugggacacccggaucaccgaggacgaccuccagaacgaggccaagaucaccgacaucauggagcccgagcacgcccugcuggccacguccaucuucaagcucaccuaccagaacaagguggugcgcguccagcgccccgccaagagcggcaccgugauggacgugaucucccggcgcgaccagcgggggagcggccaggucggcaccuacgggcugaacacguucaccaacauggaggugcagcugauccgccagauggaguccgagggcaucuucagccccuccgagcucgagaccccgaaccuggccaagaaggugcuggacuggcucgagaagcacggggccgagcggcugaagcgcauggccaucagcggcgacgacugcgucgugaagcccaucgacgaccgguucgccaccgcgcugacggcccucaacgacauggggaaggugcgcaaggacaucccccagugggagcccuccaagggcuggaacgacuggcagcaggucccguucugcagccaccacuuccaccagcugaucaugaaggacggccgggagaucguggugcccugccgcaaccaggacgagcuggucgggcgggcccgcgugucccagggcgccggguggagccuccgggagaccgccugccugggcaaguccuacgcgcagauguggcagcugauguacuuccaccgccgggaccuccgccuggccgccaacgccaucugcagcgccgugcccgucgacugggugcccaccagccggaccaccugguccauccacgcgcaccaccaguggaugacgaccgaggacaugcugagcguguggaaccgcgucuggaucgaggagaacccguggauggaggacaagacccacguguccagcugggaggaggugcccuaccucgggaagcgggaggaccaguggugcggcucccugaucggccugaccgcccgcgccacgugggccaccaacauccaggucgcgaucaaccaggugcgccggcucaucgggaacgagaacuaccuggacuacaugaccagcaugaagcgcuucaagaacgaguccgaccccgagggcgcccugugguga

SEQ ID NO: 7967 - RNA, 9879 nt, Artificial Sequence
  derived and/or modified CDS sequence (opt1) from DENV-1__FJ850090__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgcgauggaccugggcgagcucugcgaggacaccaugaccuacaagugcccccggaucaccgagguggagcccgacgacguggacugcuggugcaacgccaccgacacgugggugaccuacgggaccugcagccagaccggcgagcaccggcgcgacaagcgguccgucgcccuggcgccccacgugggccuggggcucgagacgcgcaccgagaccuggaugagcuccgagggcgccuggaagcagauccagaagguggagaccugggcgcugcggcaccccggguucacggucaucgcccuguuccucgcccacgccaucggcaccagcaucacccagaaggggaucaucuucauccugcugaugcucgugacccccuccauggcgaugcgcugcgugggcaucggcaaccgggacuucgucgaggggcugagcggcgccacguggguggacgugguccuggagcacggguccugcgugaccaccauggccaagaacaagcccacccucgacaucgagcugcugaagacggaggugaccaaccccgccguccuccgcaagcugugcaucgaggccaagaucagcaacaccaccacggacucccggugcccgacccagggcgaggcgacccugguggaggagcaggacgccaacuucgugugccgccggaccuucgucgaccgcggcugggggaacggcugcggccucuucggcaaggggagccugcugacgugcgccaaguucaagugcgugaccaagcucgagggcaagaucgugcaguacgagaaccugaaguacuccgucaucgugaccguccacaccggcgaccagcaccagguggggaacgagacgaccgagcacggcaccaucgccaccaucacgccccaggcccccacgagcgagauccagcugaccgacuacggggcgcucacccuggacugcagcccccggaccggccuggacuucaacgagauggugcuccugacgaugaaggagaaguccuggcugguccacaagcagugguuccucgaccugccgcugcccuggaccuccggggccagcaccagccaggagaccuggaaccgccaggaccuccuggugacguucaagaccgcccacgccaagaagcaggagguggucgugcugggcucccaggagggcgccaugcacaccgcgcucaccggggccacggagauccagaccagcggcaccaccacgaucuucgccgggcaccugaagugccggcugaagauggacaagcucacccugaagggcauguccuacgugaugugcaccgggagcuucaagcuggagaaggaggucgccgagacccagcacggcacggugcuggugcaggucaaguacgagggcaccgacgcccccugcaagauccccuuccucacccaggacgagaagggggugauccagaacggccgccugaucaccgcgaacccgaucgugacggacaaggagaagcccgucaacaucgagaccgagccgcccuucggggaguccuacaucguggugggcgccggcgagaaggcccugaagcucagcugguucaagaagggguccagcaucggcaagauguucgaggccaccgcgcgcggggcccgccggauggccauccugggcgacaccgccugggacuucggguccaucggcggccuguucacgagcgucgggaagcucauccaccagguguucggcaccgccuacggggugcuguucuccggcgucagcuggaccaugaagaucgggaucggcauccugcucaccuggcugggccugaacucccgcagcacgucccucagcaugaccugcaucgcgguggggauggugacccuguaccugggcgucauggugcaggccgacuccgggugcgugaucaacuggaagggccgcgagcucaagugcgggagcggcaucuucgucaccaacgaggugcacacguggaccgagcaguacaaguuccaggccgacuccccgaagcggcugagcgccgccaucggcaaggcgugggaggagggggugugcggcauccgcagcgccacccggcuggagaacaucauguggaagcagaucuccaacgagcucaacuacauccugcuggagaacgacaugaaguucaccgucguggugggggacgccaacggcauccucacccaggggaagaagaugauccgcccccagcccauggagcacaaguacagcuggaaguccuggggcaaggccaagaucaucggcgccgacauccagaacacgaccuucaucaucgacgggcccgacaccccggagugccccgacgaccagcgggcguggaacaucugggaggucgaggacuacggcuucgggaucuucaccacgaacaucuggcugaagcugcgcgacagccacacccagaugugcgaccaccggcucauguccgccgccaucaaggacagcaaggccgugcacgcggacaugggcuacuggaucgaguccgagaagaacgagaccuggaagcuggcccgcgccagcuucaucgaggugaagaccugcaucuggcccaagucccacacgcuguggagcaacggcguccucgaguccgagaugaucauccccaagaucuacgggggcccgaccagccagcacaacuaccggcccggguacuucacccagaccgccggccccuggcaccuggggaagcuggagcucgacuucgaccugugcgagggcacgaccgugguggucgacgagcacugcggcuaccgcgggccgucccugcggaccaccacggugaccggcaagaucauccacgaguggugcugccgcagcugcacccugccgccccugcgguuccgcggggaggacggcugcugguacgggauggagauccggcccgugaaggagaaggaggagaaccugguccgcuccauggugagcgccggcuccggcgagguggacagcuucagccucgggauccugugcgucuccauccugaucgaggaggugaugcggagccgcuggucccggaagaugcucaugaccggcacgcuggcgguguuccugcuccugaucauggggcagcugaccuggaacgaccucauccgccugugcaucauggucggcgccaacgccagcgaccgcauggggaugggcaccaccuaccuggcccucauggccacguucaagaugcggccgauguucgccguggggcugcuguuccgcaagcucaccucccgggaggugcugcugcucaccaucgggcugagccuggucgccuccguggagcuccccaacagccuggaggagcugggcgacgggcucgccaugggcaucaugaugcugaagcugcucaccgacuuccagccccaccagcuguggacgacccugcucucccugaccuucauccgcaccagccugucccucgacuacgccuggaagacgauggccauggcgcugagcaucgucucccuguucccccucugccugagcaccaccucccagaagaccacguggcugccggugcuccugggcagcuucgggugcaagccccugaccauguuccucaucaccgagaacaagaucuggggccggaaguccuggcccaucaacgaggggaucauggccgugggcaucgucagcauccugcuguccagccuccugaagaacgacgugccccuggccgggccgcucaucgccggcggcaugcugaucgcgugcuacgugaucagcggguccagcgccgaccugucccucgagaaggccgccgaggucagcugggaggaggaggccgagcacuccggcaccagccacaacauccugguggaggugcaggacgacgggaccaugaagaucaaggacgaggagcgcgacgacacgcugaccauccuccugaaggcgacccugcucgccgucuccggcguguaccccaugagcauccccgccacccuguucgugugguacuucuggcagaagaagaagcagcgguccgggguccugugggacacgcccagcccgcccgagguggagcgcgccgugcuggacgacggcaucuaccggauccuccagcgcggccugcuggggcggucccaggucggcguggggguguuccaggacggcgucuuccacaccauguggcacgugacccgcggggccgugcucauguaccagggcaagcggcuggagcccagcugggcguccgucaagaaggaccugaucagcuacggcgggggcuggcgcuuccagggguccuggaacaccggcgaggagguccaggugaucgccgucgagcccgggaagaacccgaagaacgugcagacgacccccggcaccuucaagacccccgagggcgaggugggggccaucgcccucgacuucaagcccggcacgagcggguccccgaucgucaaccgggagggcaagaucgugggccuguacgggaacggcguggucaccaccagcgggaccuacguguccgccaucgcgcaggccaaggccagccaggagggcccccugcccgagaucgaggacgagguguucaagaagcgcaaccucacgaucauggaccugcacccggggagcggcaagacccggcgcuaccugcccgccaucguccgggaggccaucaagcgcaagcuccggacccugauccuggcgcccacccgcgugguggccuccgagauggccgaggcccucaagggcaugcccauccgcuaccagacgaccgcggucaagagcgagcacaccgggcgggagaucguggaccugaugugccacgccaccuucacgaugcgccugcucuccccggugcggguccccaacuacaacaugaucaucauggacgaggcccacuucaccgaccccgccagcaucgccgcgcgcggcuacaucuccacccggguggggaugggcgaggccgccgccaucuucaugaccgccacgcccccggggagcguggaggcguucccccaguccaacgccgucauccaggacgaggagcgcgacauccccgagcggagcuggaacuccggcuacgacuggaucaccgacuuccccggcaagaccgugugguucgugccgagcaucaaguccgggaacgacaucgccaacugccugcgcaagaacggcaagcgggucauccagcugagccgcaagaccuucgacacggaguaccagaagaccaagaacaacgacugggacuacguggugaccaccgacaucuccgagaugggggccaacuuccgggccgaccgcgucaucgacccccggcgcugccucaagcccgugauccugaaggacggccccgagcgggugauccuggcggggccgaugcccgucacgguggccagcgccgcccagcgccggggccgcaucggccggaaccagaacaaggagggggaccaguacaucuacaugggccagccccucaacaacgacgaggaccacgcgcacuggaccgaggccaagaugcugcuggacaacaucaacacccccgaggggaucaucccggcccucuucgagcccgagcgcgagaaguccgccgccaucgacggcgaguaccgccugcgcggggaggcgcgcaagaccuucgucgagcugaugcggcgcggcgaccuccccguguggcugagcuacaagguggccuccgagggcuuccaguacagcgaccggcgcuggugcuucgacggggagcggaacaaccagguccuggaggagaacauggacguggagaucuggacgaaggagggcgagcgcaagaagcuccggccccgcuggcuggacgcccggaccuacuccgacccgcuggcccuccgcgaguucaaggaguucgccgcggggcggcgcagcgugagcggcgaccugauccuggagaucggcaagcucccccagcaccugacccugcgggcccagaacgcccucgacaaccuggucaugcugcacaacuccgagcagggcgggaaggccuaccgccacgccauggaggagcuccccgacaccaucgagacccugaugcugcucgcgcugaucgccgugcugaccggcggggugacccucuucuuccugagcgggaaggggcugggcaagaccuccaucgggcuccugugcgucauggccagcuccgcccugcucuggauggcgagcguggagccccacuggaucgccgccuccaucauccuggaguucuuccugauggugcuccugaucccggagcccgaccggcagcgcacgccccaggacaaccagcuggccuacgucgugaucggccuccuguucaugauccugacgguggccgcgaacgagauggggcuccuggagaccaccaagaaggaccugggcaucgggcacgucgccgccgagaaccaccaccacgccaccaugcucgacguggaccugcggccggccagcgcguggacgcuguacgccguggccaccaccgucaucacccccaugaugcgccacacgaucgagaacaccaccgccaacaucucccucaccgccaucgcgaaccaggccgccauccugaugggccuggacaagggcuggcccaucagcaagauggacaucggggugccccuccuggcccugggcugcuacucccaggugaacccgcucacgcugaccgccaccguccugaugcucguggcgcacuacgccaucaucgggcccggccugcaggccaaggccacccgggaggcgcagaagcgcacggccgccgggaucaugaagaaccccaccguggacggcaucgucaccaucgaccuggaccccgugguguacgacgccaaguucgagaagcagcucggccagaucaugcugcugauccucugcaccagccagauccugcugaugcgcacgaccugggcccucugcgaguccaucacccuggcgaccgggccgcugacgacccucugggagggcagccccgggaaguucuggaacaccaccaucgccgucuccauggccaacaucuuccggggcagcuaccuggccggcgccgggcuggcguucucccucaugaagucccugggcgggggccgccgggggacgggcgcccagggcgagacccugggggagaaguggaagcgccagcucaaccagcuguccaagagcgaguucaacaccuacaagaaguccggcaucauggagguggaccgguccgaggccaaggaggggcugaagcgcggcgagaccacgaagcacgccgugagccgggggaccgccaagcugcgcugguucgucgagcggaaccucgugaagcccgagggcaaggugaucgaccugggcugcgggcgcggcgggugguccuacuacugcgcgggccugaagaaggucaccgaggugaagggguacaccaagggcggccccgggcacgaggagccgauccccauggccaccuacggcuggaaccucgugaagcugcacagcgggaaggacgucuucuucacgccgcccgagaagugcgacacccugcucugcgacaucggcgaguccagcccgaaccccaccaucgaggaggggcggacccugcgcgugcugaagaugguggagcccuggcuccggggcaaccaguucugcaucaagauccugaaccccuacaugccguccgucguggagacgcuggagcagaugcagcgcaagcacggcgggaugcucgugcggaacccccugagccgcaacuccacccacgagauguacugggucagcugcggcaccgggaacaucguguccgccgugaacaugaccagccggaugcugcucaaccgcuucacgauggcccaccggaagcccaccuacgagcgcgacgucgaccugggcgcgggcacccgccacguggccguggagcccgaggucgccaaccuggacaucaucgggcagcggaucgagaacaucaagaacgagcacaaguccaccuggcacuacgacgaggacaacccguacaagacgugggccuaccacggcagcuacgaggugaagcccuccgggagcgccuccagcauggugaacggcgucgugcgccuccugaccaagcccugggacgucauccccauggugacccagaucgcgaugaccgacacgaccccguucgggcagcagcggguguucaaggagaaggucgacacccgcacgccccgggccaagcgcggcacggcccagaucauggaggugaccgccaaguggcugugggacuuccucucccggaacaagaagccccgcaucugcacccgggaggaguucacccgcaaggugcggagcaacgccgcgaucggcgccgucuucguggacgagaaccaguggaacagcgccaaggaggccguggaggacgagcgcuucugggaccugguccaccgggagcgcgagcugcacaagcaggggaagugcgccacgugcguguacaacaugaugggcaagcgggagaagaagcucggggaguucggcaaggcgaaggggucccgcgccaucugguacauguggcugggcgcccgguuccuggaguucgaggcccucggcuucaugaacgaggaccacugguucagccgcgagaacucccugagcgggguggagggcgaggggcugcacaagcucggcuacauccugcgggacaucuccaagauccccggcgggaacauguacgcggacgacaccgccgggugggacacccgcaucaccgaggacgaccugcagaacgaggccaagaucacggacaucauggagcccgagcacgcccuccuggccaccagcaucuucaagcugaccuaccagaacaaggucgugcgggugcagcgccccgcgaaguccgggaccgucauggacgugaucagccgccgggaccagcgcggcuccggccaggugggcacguacggccucaacaccuucaccaacauggagguccagcugauccggcagauggagagcgaggggaucuucucccccagcgagcuggagaccccgaaccucgccaagcgcgugcuggacuggcuggagaagcacggcgccgagcggcucaagcgcauggccaucuccggggacgacugcguggucaagcccaucgacgaccgguucgccacggcgcugaccgcccugaacgacaugggcaaggugcgcaaggacaucccccagugggagcccagcaagggguggaacgacuggcagcaggucccguucugcucccaccacuuccaccagcucaucaugaaggacggccgggacaucgucgugcccugccgcaaccaggacgagcuggugggccgggcccgcgucagccagggggccggcuggucccugcgggagaccgccugccucggcaagagcuacgcgcagauguggcagcugauguacuuccaccgccgggaccugcgccucgccgccaacgccaucugcagcgccgugcccguggacuggguccccaccucccggaccacguggagcauccacgcgcaccaccaguggaugaccaccgaggacaugcuguccguguggaaccgcguguggaucgaggagaacccguggauggaggacaagacccacgucagcuccugggaggaggugcccuaccugggcaagcgggaggaccaguggugcgggagccucaucggccugacggcccgcgccaccugggccaccaacauccagguggcgaucaaccagguccgccggcugaucggcaacgagaacuaccucgacuacaugaccuccaugaagcgcuucaagaacgagagcgaccccgagggggcccugugguga

SEQ ID NO: 7968 - RNA, 9879 nt, Artificial Sequence
  derived and/or modified CDS sequence (opt1) from DENV-1__FJ850093__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccacccaccuggcccucauggccacguucaagaugcgcccgauguucgccguggggcugcuguuccggcgccucaccagccgggaggugcugcugcucaccaucgggcugucccugauggccagcauggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccaugauccugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagaccacgggccgcgagaucguggaccugaugugccacgccaccuucaccaugcggcuccuguccccgguccgcgugcccaacuacaacaugaucaucauggacgaggcgcacuucaccgaccccgccagcaucgccgcccggggguacaucuccacgcgcgugggcaugggggaggccgcggccaucuucaugaccgccacgccgcccggcagcgucgaggccuucccccaguccaacgccgugauccaggacgaggagcgggacauccccgagcgcagcuggaacuccggcuacgacuggaucaccgacuuccccgggaagacggugugguucguccccagcaucaaguccggcaacgacaucgcgaacugccugcggaagaacgggaagcgcgugauccagcucagccggaagaccuucgacaccgaguaccagaagaccaagaacaacgacugggacuacguggucacgaccgacaucuccgagaugggcgccaacuuccgcgccgaccgggugaucgacccccgccggugccugaagcccgugauccugaaggacgggcccgagcgcgucauccucgccggcccgaugcccgugaccguggcgagcgccgcccagcggcgcggccggaucgggcgcaaccagaacaaggagggcgaccaguacgucuacauggggcagccccugaacaacgacgaggaccacgcccacuggaccgaggccaagaugcugcucgacaacaucaacacgcccgagggcaucaucccggcgcuguucgagcccgagcgcgagaaguccgccgccaucgacggggaguaccggcugcgcggcgaggcccggaagaccuucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacacgaucgagacccugaugcuccuggcccugaucgcgguccucaccggcggggugacccuguucuuccugagcggcaagggccucgggaagacguccaucggccugcugugcgugaccgccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagacgaccaagaaggaccucgggaucggcuacguggccgcggagaaccaccagcacgccaccaugcuggacgucgaccugcgcccggccagcgccuggacccucuacgccguggcgacgaccgugaucacccccaugaugcggcacaccaucgagaacacgaccgccaacaucucccugaccgccaucgccaaccaggccgcgauccugaugggccucgacaagggguggcccaucagcaagauggacaucggcgucccccugcuggcccucgggugcuacucccaggugaacccgcugacccugacggccgccgugcucaugcuggucgcgcacuacgccaucaucggccccgggcugcaggccaaggccacccgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcacgagccagauccugcucaugcggaccaccugggcccugugcgaguccaucacccuggcgacgggcccgcucaccacccugugggaggggagccccggcaaguucuggaacaccacgaucgccguguccauggccaacaucuuccgcggcagcuaccuggccggggccggccucgcguucucccugaugaagucccucgggggcgggcggcgcgggaccggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagacgaccaagcacgccgugagccggggcaccgcgaagcugcgcugguucguggagcggaaccuggucaagcccgagggcaaggugaucgaccuggggugcggccgcgggggcugguccuacuacugcgccgggcucaagcgggugaccgaggucaagggcuacaccaagggcgggcccggccacgaggagccgauccccauggccacguacggguggaaccuggugaagcugcacagcggcaaggacguguucuucaugccgcccgagaagugcgacacccuccugugcgacaucggggaguccagcccgaaccccaccaucgaggagggccgcacccugcggguccucaagaugguggagcccuggcugaagggcaaccaguucugcaucaagauccugaaccccuacaugccguccguggucgagacgcucgagcagaugcagcgcaagcacgggggcaugcuggugcggaacccccugagccgcaacuccacccacgagauguacugggugagcugcgggaccggcaacaucgucuccgccgugaacaugaccagccggaugcuccugaaccgcuucacgauggcccaccgcaagcccaccuacgagcgggacguggaccugggcgcggggacccgccacgucgccguggagcccgagguggccaaccucgacaucaucggccagcggaucgagaacaucaagaacgagcacaaguccaccuggcacuacgacgaggacaacccguacaagacgugggccuaccacgggagcuacgaggucaagcccuccggcagcgccuccagcauggugaacggggugguccgccugcugaccaagcccugggacgugauccccauggucacccagaucgcgaugaccgacacgaccccguucggccagcagcggguguucaaggagaagguggacacccgcacgccccgggccaagcgcggcacgacccagaucauggaggucaccgccaaguggcucuggggguuccugucccggaacaagaagccccgcaucugcacccgggaggaguucacgcgcaaggugcggagcaacgccgccaucggcgcgguguucgucgacgagaaccaguggaacagcgccaaggaggccguggaggacgagcgcuucugggaccuggugcaccgggagcgcgagcuccacaagcaggggaagugcgcgaccugcgucuacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacaccgcgggcugggacacccgcaucacggaggacgaccuccagaacgaggccaagaucaccgacaucauggagcccgagcacgcccugcuggccaccagcaucuucaagcucaccuaccagaacaaggugguccgcgugcagcggcccgccaagaacgggacggugauggacgucaucucccgccgggaccagcgcggcagcggccagguggggaccuacggccugaacaccuucaccaacauggaggugcagcugauccggcagauggaguccgaggggaucuuccuccccagcgagcuggagacgccgaaccuggcggagcgcguccucgacuggcuggagaagcacggcgccgagcggcugaagcgcauggccaucuccggggacgacugcguggugaagcccaucgacgaccgguucgccaccgcccucaccgcgcugaacgacaugggcaagguccgcaaggacaucccccagugggagcccagcaagggcuggaacgacuggcagcaggucccguucugcucccaccacuuccaccagcugaucaugaaggacgggcgggagaucgugguccccugccgcaaccaggacgagcucgugggccgggcccgcgugagccagggggccggcuggucccugcgggagaccgccugccugggcaagagcuacgcccagauguggcagcucauguacuuccaccgccgggaccugcgccuggcggccaacgccaucugcuccgccguccccguggacugggugcccaccagccggacgaccuggagcauccacgcgcaccaccaguggaugaccaccgaggacaugcucuccgucuggaaccgcguguggaucgaggagaacccguggauggaggacaagacgcacgugagcuccugggaggagguccccuaccugggcaagcgcgaggaccaguggugcggcagccugaucgggcucaccgcccgggccaccugggccaccaacauccagguggccaucaaccaggugcgccggcugaucggcaacgagaacuaccuggacuacaugacguccaugaagcgcuucaagaacgagagcgaccccgagggggcgcucugguga

SEQ ID NO: 7969 - RNA, 9879 nt, Artificial Sequence
  derived and/or modified CDS sequence (opt1) from DENV-1__GU131863__SS-prME
agcgugaccaugcugcucaugcugcugcccaccgcccucgccuuccaccugaccacccggggcggggagccccacaugaucgugagcaagcaggagcggggcaagagccuccucuucaagaccagcgugggggugaacaugugcacccugaucgcgauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgucggccuggggcucgagacgcgcaccgagaccuggaugagcuccgagggcgccuggaagcagauccagaagguggagaccugggcccugcggcaccccggguucacggugaucgcccuguuccucgcccacgcgaucggcaccagcaucacccagaaggggaucaucuucauccugcugaugcucgucacccccuccauggccaugcgcugcgugggcaucggcaaccgggacuucguggaggggcugagcggcgccacgugggucgacguggugcuggagcacggguccugcgucaccaccauggccaagaacaagcccacccucgacaucgagcugcugaagacggaggugaccaaccccgccgugcuccgcaagcugugcaucgaggcgaagaucagcaacaccaccacggacucccggugccccacccagggcgaggccacccuggucgaggagcaggacgccaacuucgugugccgccggaccuucguggaccgcggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccggaccggccuggacuucaacgagauggugcuccugacgaugaaggagaaguccuggcuggugcacaagcagugguuccucgaccugccgcugcccuggaccuccggggccagcaccagccaggagaccuggaaccgccaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccggcugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuuccucacccaggacgagaagggggucacccagaacggccgccugaucacggccaacccgaucgugaccgacaaggagaagcccgugaacaucgagaccgagccgcccuucggggaguccuacaucgucgugggcgccggcgagaaggcccugaagcucagcugguucaagaagggguccagcaucggcaagauguucgaggcgaccgcccgcggggcccgccggauggccauccugggcgacacggccugggacuucggguccaucggcggccuguucaccagcguggggaagcucauccaccaggucuucggcaccgcguacggggugcuguucuccggcgugagcuggaccaugaagaucgggaucggcauccugcucacguggcugggccugaacucccgcagcaccucccucagcaugaccugcaucgccgucgggauggugacccuguaccugggcgugaugguccaggccgacuccgggugcgugaucaacuggaagggccgcgagcucaagugcgggagcggcaucuucgugacgaacgagguccacaccuggaccgagcaguacaaguuccaggccgacuccccgaagcggcugagcgccgcgaucggcaaggccugggaggagggggugugcggcauccgcagcgccacccggcuggagaacaucauguggaagcagaucuccaacgagcucaacuacauccugcuggagaacgacaugaaguucaccguggucgugggggacaucaacggcauccucgcccaggggaagaagaugauccgcccccagcccauggagcacaaguacagcuggaaguccuggggcaaggccaagaucaucggcgcggacauccagaacacgaccuucaucaucgacgggcccgacaccccggagugccccgacgaccagcgggccuggaacaucugggagguggaggacuacggcuucgggaucuucaccacgaacaucuggcugaagcugcgcgacagccacacccagaugugcgaccaccggcucauguccgccgccaucaaggacagcaaggcgguccacgccgacaugggcuacuggaucgaguccgagaagaacgagaccuggaagcuggcccgcgccagcuucaucgaggugaagaccugcaucuggcccaagucccacacgcuguggagcaacggcgugcucgaguccgagauggucauccccaagaucuacgggggcccgaucagccagcacaacuaccggcccggguacuucacccagaccgccggccccuggcaccuggggaagcuggagcucgacuucgaccugugcgagggcaccacggugguggucgacgagcacugcggcuaccgcgggccgucccugcggaccaccaccgugacgggcaagaucauccacgaguggugcugccgcagcugcacccugccgccccugcgguuccgcggggaggacggcugcugguacgggauggagauccggcccgugaaggagaaggaggagaaccugguccgcuccauggugagcgcgggcuccggcgagguggacagcuucagccucgggauccugugcgucuccauccugaucgaggaggugaugcggagccgcuggucccggaagaugcucaugaccggcacccuggccguguuccugcuccugaucauggggcagcugacguggaacgaccucauccgccugugcaucauggucggcgccaacgccagcgaccgcauggggaugggcaccaccuaccuggcccucauggcgaccuucaagaugcggccgauguucgccgugggccugcuguuccgccggcucacgucccgcgaggugcugcugcucaccgucgggcugagccugguggccuccgucgagcuccccaacagccuggaggagcugggcgacgggcucgccaugggcaucaugaugcugaagcugcucaccgacuuccagccccaccagcuguggaccacgcugcucucccugaccuucauccggaccagccugucccucgacuacgccuggaagaccauggcgauggcccugagcaucgugucccuguucccccucugccugagcacgaccucccagaagaccaccuggcugccggugcuccugggcagcuucgggugcaagccccugacgauguuccucaucaccgagaacaagaucuggggccgcaaguccuggcccaucaacgaggggaucauggccgucggcaucgugagcauccugcuguccagccuccugaagaacgacgugccccuggccgggccgcucaucgcgggcggcaugcugaucgccugcuacgucaucagcggguccagcgccgaccugucccucgagaaggccgccgaggugagcugggaggaggaggcggagcacuccggcaccagccacaacauccugguggagguccaggacgacgggaccaugaagaucaaggacgaggagcgggacgacacccugacgauccuccugaaggccacccugcucgccguguccggcguguaccccaugagcauccccgccacccuguucgucugguacuucuggcagaagaagaagcagcgcuccggggugcugugggacacccccagcccgcccgagguggagcgggccguccuggacgacggcaucuaccgcauccuccagcggggccugcuggggcgcucccaggugggcgugggggucuuccaggacggcguguuccacacgauguggcacgugacccgcggggcgguccucauguaccagggcaagcgccuggagcccagcugggccuccgugaagaaggaccugaucagcuacggcgggggcuggcgguuccagggguccuggaacaccggcgaggaggugcaggucaucgccguggagcccgggaagaacccgaagaacgugcagaccacgcccggcaccuucaagacccccgagggcgaggucggggccaucgcccucgacuucaagcccggcaccagcggguccccgaucgugaaccgcgagggcaagaucgugggccuguacgggaacggcgucgugacgaccagcgggaccuacguguccgcgaucgcccaggccaaggccacccaggagggcccccugcccgagaucgaggacgaggucuucaagaagcggaaccucacgaucauggaccugcacccggggagcggcaagacccgccgguaccugcccgccaucgugcgcgaggcgaucaagcggaagcuccgcacccugauccuggcccccacccgcguggucgccagcgagauggccgaggcgcucaagggcaugcccauccgguaccagacgaccgccgugaaguccgagcacaccgggcgcgagaucguggaccugaugugccacgccaccuucacgaugcggcugcucagcccgguccgcgugcccaacuacaacaugaucaucauggacgaggcccacuucaccgaccccgccuccaucgcggcccggggcuacaucagcacccgcguggggaugggcgaggccgccgccaucuucaugaccgcgacgcccccgggguccgucgaggccuucccccagagcaacgccgugauccaggacgaggagcgggacauccccgagcgcuccuggaacagcggcuacgacuggaucaccgacuuccccggcaagaccgugugguucgucccguccaucaagagcgggaacgacaucgccaacugccugcggaagaacggcaagcgcgugauccagcugucccggaagaccuucgacacggaguaccagaagaccaagaacaacgacugggacuacguggucaccaccgacaucagcgagaugggggccaacuuccgcgcggaccgggugaucgacccccgccggugccucaagcccgugauccugaaggagggccccgagcgcgucauccuggccgggccgaugcccgugacggucgccuccgccgcgcagcggcgcggccggaucggccgcaaccagaacaaggagggggaccaguacaucuacaugggccagccccucaacaacgacgaggaccacgcccacuggaccgaggccaagaugcugcuggacaacaucaacacccccgaggggaucaucccggcccucuucgagcccgagcgcgagaaguccgccgcgaucgacggcgaguaccggcugcgcggggaggcccggaagaccuucguggagcugaugcgccggggcgaccuccccguguggcuguccuacaaggucgccagcgagggcuuccaguacuccgaccgccgguggugcuucgacggggagcgcaacaaccaggugcuggaggagaacauggacguggagaucuggacgaaggagggcgagcggaagaagcuccgcccccgguggcuggacgcccgcaccuacagcgacccgcuggcccuccgggaguucaaggaguucgcggccgggcgccgguccgucagcggcgaccugauccuggagaucggcaagcucccccagcaccugacccugcgcgcccagaacgcccucgacaaccuggugaugcugcacaacagcgagcagggcgggaaggccuaccggcacgcgauggaggagcuccccgacaccaucgagacccugaugcugcucgcccugaucgccgugcugaccggcggggucacccucuucuuccuguccgggaaggggcugggcaagaccagcaucgggcuccugugcgugauggccuccagcgcgcugcucuggauggccuccguggagccccacuggaucgccgccagcaucauccuggaguucuuccugaugguccuccugaucccggagcccgaccgccagcggacgccccaggacaaccagcuggccuacguggugaucggccuccuguucaugauccugacggucgcggccaacgagauggggcuccuggagaccaccaagaaggaccugggcaucgggcacguggccguggagaaccaccaccacgccaccaugcucgacgucgaccugcgcccggccuccgcguggacgcuguacgccguggccaccaccgugaucacccccaugaugcggcacacgaucgagaacaccaccgccaacaucagccucaccgccaucgcgaaccaggccgccauccugaugggccuggacaagggcuggcccaucuccaagauggacaucggggucccccuccuggcccugggcugcuacagccaggugaacccgcucacgcugaccgccgcggugcugaugcucgucgcccacuacgccaucaucgggcccggccugcaggccaaggcgacccgcgaggcccagaagcgcaccgccgccgggaucaugaagaaccccacgguggacggcaucgugaccaucgaccuggaccccgucguguacgacgccaaguucgagaagcagcucggccagaucaugcugcugauccucugcaccucccagauccugcugaugcggaccacgugggcgcucugcgagagcaucacccuggccaccgggccgcugaccacgcucugggagggcucccccgggaaguucuggaacaccaccaucgccgugagcauggccaacaucuuccgcggcuccuaccuggccggcgcggggcuggccuucagccucaugaagucccugggcgggggccggcgcgggaccggcgcccagggcgagacgcugggggagaaguggaagcggcagcucaaccagcugagcaaguccgaguucaacaccuacaagaaguccggcaucauggaggucgaccgcagcgaggccaaggaggggcugaagcggggcgagaccaccaagcacgccgugucccgcgggacggcgaagcugcggugguucguggagcgcaaccucgucaagcccgagggcaaggugaucgaccugggcugcgggcggggcggguggagcuacuacugcgccggccugaagaaggugaccgaggucaagggguacaccaagggcggccccgggcacgaggagccgauccccauggccaccuacggcuggaaccucgugaagcugcacuccgggaaggacguguucuucacgccgcccgagaagugcgacacgcugcucugcgacaucggcgagagcuccccgaaccccaccaucgaggaggggcgcacccugcggguccugaagaugguggagcccuggcuccgcggcaaccaguucugcaucaagauccugaaccccuacaugccgagcguggucgagacccuggagcagaugcagcggaagcacggcgggaugcucgugcgcaacccccugucccggaacagcacgcacgagauguacuggguguccugcggcaccgggaacaucgucagcgccgugaacaugaccucccgcaugcugcucaaccgguucaccauggcgcaccgcaagcccacguacgagcgcgacguggaccugggcgccggcacccggcacgucgccguggagcccgagguggccaaccuggacaucaucgggcagcgcaucgagaacaucaagaacgagcacaagagcaccuggcacuacgacgaggacaacccguacaagaccugggccuaccacggcuccuacgaggucaagcccagcggguccgcgagcuccauggugaacggcgucgugcggcuccugacgaagcccugggacgugauccccauggucacccagaucgccaugaccgacaccacgccguucgggcagcagcgcguguucaaggagaagguggacacccggacgccccgggccaagcggggcaccgcccagaucauggaggucacggccaaguggcuguggggcuuccucagccgcaacaagaagccccggaucugcacccgcgaggaguucacccggaaggugcgcuccaacgcggccaucggggccguguucgucgacgagaaccaguggaacagcgccaaggaggccguggaggacgagcgguucugggaccuggugcaccgcgagcgggagcugcacaagcagggcaagugcgcgaccugcgucuacaacaugauggggaagcgcgagaagaagcucggcgaguucgggaaggccaagggcagccgggccaucugguacauguggcugggcgcccgcuuccuggaguucgaggcgcucggguucaugaacgaggaccacugguucucccgggagaacagccuguccggcguggagggggagggccugcacaagcucggguacauccugcgcgacaucagcaagaucccgggcggcaacauguacgccgacgacacggccgggugggacacccggaucaccgaggacgaccugcagaacgaggccaagaucaccgacaucauggagcccgagcacgcccuccuggcgacguccaucuucaagcugaccuaccagaacaaggugguccgcgugcagcgccccgccaagagcggcaccgugauggacgucaucucccggcgcgaccagcgggggagcggccaggugggcaccuacgggcucaacacguucaccaacauggaggugcagcugauccgccagauggaguccgagggcaucuucagccccuccgagcuggagaccccgaaccucgccaagaagguccuggacuggcuggagaagcacggggccgagcggcucaagcgcauggccaucagcggcgacgacugcguggugaagcccaucgacgaccgguucgcgaccgcccugacggcccugaacgacauggggaagguccgcaaggacaucccccagugggagcccuccaagggcuggaacgacuggcagcaggucccguucugcagccaccacuuccaccagcucaucaugaaggacggccgggagaucgugguccccugccgcaaccaggacgagcugguggggcgggcccgcgugucccagggcgccggguggagccugcgggagaccgcgugccucggcaaguccuacgcccagauguggcagcugauguacuuccaccgccgggaccugcgccucgccgccaacgccaucugcagcgcgguccccguggacugggugcccaccagccggaccaccugguccauccacgcccaccaccaguggaugacgaccgaggacaugcugagcgucuggaaccgcguguggaucgaggagaacccguggauggaggacaagacccacguguccagcugggaggagguccccuaccuggggaagcgggaggaccaguggugcggcucccucaucggccugaccgcccgcgccacgugggcgaccaacauccagguggccaucaaccaggugcgccggcugaucgggaacgagaacuaccucgacuacaugaccagcaugaagcgcuucaagaacgaguccgaccccgagggcgcccugugguga

SEQ ID NO: 7970 - RNA, 9879 nt, Artificial Sequence
  derived and/or modified CDS sequence (opt1) from DENV-1__GQ868559__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccgucgcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggugacccuguucuuccugagcggcaagggccucgggaagaccuccaucggccugcugugcgugacggccagcuccgcccuccuguggauggccagcgucgagccccacuggaucgccgcguccaucauccuggaguucuuccucauggugcugcugaucccggagcccgaccgccagcggacgccccaggacaaccagcucgccuacguggucaucgggcugcuguucaugauccucaccguggccgccaacgagaugggccugcuggagaccacgaagaaggaccucgggaucggcuacguggccgcggagaaccaccagcacgccaccaugcuggacgucgaccugcgcccggccagcgccuggacccucuacgccguggcgaccacggugaucacccccaugaugcggcacaccaucgagaacaccacggccaacaucucccugaccgccaucgccaaccaggccgcgauccugaugggccucgacaagggguggcccaucagcaagauggacaucggcgucccccugcuggcccucgggugcuacucccaggugaacccgcugacccugaccgccgccgugcucaugcuggucgcgcacuacgccaucaucggccccgggcugcaggccaaggccacgcgcgaggcccagaagcgcaccgcggccggcaucaugaagaaccccaccguggacggcaucguggccaucgaccucgaccccgucguguacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccguguccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggaggucgaccgguccgaggccaaggagggccucaagcgcggggagaccacgaagcacgccgugagccggggcaccgcgaagcugcgcugguucguggagcggaaccuggucaagcccgagggcaaggugaucgaccuggggugcggccgcgggggcugguccuacuacugcgccgggcucaagaaggugaccgaggucaagggcuacaccaagggcgggcccggccacgaggagccgauccccauggccaccuacggguggaaccuggugaagcugcacagcggcaaggacguguucuucaugccgcccgagaagugcgacacgcuccugugcgacaucggggaguccagcccgaaccccaccaucgaggagggccggacccugcgcguccucaagaugguggagcccuggcugcggggcaaccaguucugcaucaagauccugaaccccuacaugccguccguggucgagacccucgagcagaugcagcgcaagcacgggggcaugcuggugcggaacccccugagccgcaacuccacgcacgagauguacugggugagcugcgggaccggcaacaucgucuccgccgugaacaugaccagccggaugcuccugaaccgcuucaccauggcccaccgcaagcccacguacgagcgggacguggaccugggcgcggggacccgccacgucgccguggagcccgaggaggccaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggucaacggggugguccgccugcugacgaagcccugggacgugauccccauggugacccagaucgcgaugaccgacaccacgccguucggccagcagcgggucuucaaggagaagguggacacccgcacgccccgggccaagcgcggcaccacgcagaucauggaggugaccgccaaguggcucuggggguuccugucccggaacaagaagccccgcaucugcacccgggaggaguucacccgcaagguccggagcaacgccgccaucggcgcgguguucguggacgagaaccaguggaacagcgccaaggaggccgucgaggacgagcgcuucugggaccuggugcaccgggagcgcgagcuccacaagcaggggaagugcgccacgugcguguacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcggggucgagggcgaggggcuccacaagcugggcuacauccugcgggacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaagguggugcgcguccagcggcccgccaagaacgggaccgugauggacgugaucucccgccgggaccagcgcggcagcggccaggucgggacguacggccugaacaccuucaccaacauggaggugcagcugauccggcagauggaguccgaggggaucuuccuccccagcgagcuggagaccccgaaccuggcggagcgcgugcucgacuggcuggagaagcacggcgccgagcggcugaagcgcauggccaucuccggggacgacugcgucgugaagcccaucgacgaccgguucgccacggcccucaccgcgcugaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcucgucggccgggcccgcgugagccagggggccggcuggucccugcgggagaccgccugccugggcaagagcuacgcccagauguggcagcucauguacuuccaccgccgggaccugcgccuggcggccaacgccaucugcuccgccgugcccgucgacugggugcccaccagccggaccacguggagcauccacgcgcaccaccaguggaugaccaccgaggacaugcucuccguguggaaccgcgucuggaucgaggagaacccguggauggaggacaagacccacgugagcuccugggaggaggugcccuaccugggcaagcgcgaggaccaguggugcggcagccugaucgggcucacggcccgggccaccugggccaccaacauccaggucgccaucaaccaggugcgccggcugaucggcaacgagaacuaccuggacuacaugaccuccaugaagcgcuucaagaacgagagcgaccccgagggggcgcucugguga

SEQ ID NO: 7971 - RNA, 9879 nt, Artificial Sequence
  derived and/or modified CDS sequence (opt1) from DENV-1__GQ868560__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccaucaagaaggaccucaucagcuacgggggcggguggcgguuccagggcuccuggaacacgggggaggagguccaggugaucgccgucgagcccggcaagaacccgaagaacgugcagaccacccccggcaccuucaagacgcccgagggggaggugggcgcgaucgcccuggacuucaagcccgggaccagcggcuccccgaucgucaaccgcgagggcaagaucguggggcuguacggcaacgggguggucaccaccagcggcacguacguguccgccaucgcccaggccaaggcgagccaggaggggccccuccccgagaucgaggacgagguguucaagaagcggaaccugaccaucauggaccugcacccgggcagcggcaagacccgccgguaccuccccgccaucguccgcgaggccaucaagcggaagcugcgcacccugauccucgcccccacgcgcgugguggcguccgagauggccgaggcccugaaggggaugcccauccgguaccagaccaccgccgucaagagcgagcacaccggccgcgagaucguggaccugaugugccacgccacguucaccaugcggcuccuguccccggugcgcguccccaacuacaacaugaucaucauggacgaggcgcacuucaccgaccccgccagcaucgccgcccggggguacaucuccacccgcgugggcaugggggaggccgcggccaucuucaugacggccacgccgcccggcagcguggaggccuucccccaguccaacgccgucauccaggacgaggagcgggacauccccgagcgcagcuggaacuccggcuacgacuggaucaccgacuuccccgggaagaccgugugguucgugcccagcaucaaguccggcaacgacaucgcgaacugccugcggaagaacgggaagcgcgucauccagcucagccggaagacguucgacaccgaguaccagaagaccaagaacaacgacugggacuacguggugaccacggacaucuccgagaugggcgccaacuuccgcgccgaccgggucaucgacccccgccggugccugaagcccgugauccugaaggacgggcccgagcgcgugauccucgccggcccgaugcccgucaccguggcgagcgccgcccagcggcgcggccggaucgggcgcaaccagaacaaggagggcgaccaguacgucuacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccguguggcugagcuacaaggucgccuccgagggguuccaguacagcgaccgccgguggugcuucgacggcgagcgcaacaaccaggugcucgaggagaacauggacguggagaucuggaccaaggagggggagcggaagaagcugcgcccccgguggcuggacgcgcgcaccuacuccgacccgcucgcccugcgggaguucaaggaguucgccgccggccgccggagcgucagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcggugcucaccggcggggucacccuguucuuccugagcggcaagggccucgggaagaccuccaucggccugcugugcgugacggccagcuccgcccuccuguggauggccagcguggagccccacuggaucgccgcguccaucauccuggaguucuuccucaugguccugcugaucccggagcccgaccgccagcggacgccccaggacaaccagcucgccuacguggugaucgggcugcuguucaugauccucaccgucgccgccaacgagaugggccugcuggagaccacgaagaaggaccucgggaucggcuacguggccgcggagaaccaccagcacgccaccaugcuggacguggaccugcgcccggccagcgccuggacccucuacgccgucgcgaccacggugaucacccccaugaugcggcacaccaucgagaacaccacggccaacaucucccugaccgccaucgccaaccaggccgcgauccugaugggccucgacaagggguggcccaucagcaagauggacaucggcgugccccugcuggcccucgggugcuacucccaggucaacccgcugacccugaccgccgccgugcucaugcugguggcgcacuacgccaucaucggccccgggcugcaggccaaggccacgcgcgaggcccagaagcgcaccgcggccggcaucaugaagaaccccaccgucgacggcaucguggccaucgaccucgaccccguggucuacgacgccaaguucgagaagcagcuggggcagaucaugcugcucauccugugcaccagccagauccugcucaugcggacgaccugggcccugugcgaguccaucacccuggcgaccggcccgcucacgacccugugggaggggagccccggcaaguucuggaacaccaccaucgccguguccauggccaacaucuuccgcggcagcuaccuggccggggccggccucgcguucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgccgucagccggggcaccgcgaagcugcgcugguucguggagcggaaccuggugaagcccgagggcaaggucaucgaccuggggugcggccgcgggggcugguccuacuacugcgccgggcucaagaaggugaccgaggugaagggcuacaccaagggcgggcccggccacgaggagccgauccccauggccaccuacggguggaaccuggucaagcugcacagcggcaaggacguguucuucaugccgcccgagaagugcgacacgcuccugugcgacaucggggaguccagcccgaaccccaccaucgaggagggccggacccugcgcgugcucaagauggucgagcccuggcugcggggcaaccaguucugcaucaagauccugaaccccuacaugccguccgugguggagacccucgagcagaugcagcgcaagcacgggggcaugcugguccggaacccccugagccgcaacuccacgcacgagauguacugggugagcugcgggaccggcaacaucguguccgccgucaacaugaccagccggaugcuccugaaccgcuucaccauggcccaccgcaagcccacguacgagcgggacguggaccugggcgcggggacccgccacguggccgucgagcccgaggaggccaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggugaacggggucgugcgccugcugacgaagcccugggacgucauccccauggugacccagaucgcgaugaccgacaccacgccguucggccagcagcggguguucaaggagaaggucgacacccgcacgccccgggccaagcgcggcaccacgcagaucauggaggugaccgccaaguggcucuggggguuccugucccggaacaagaagccccgcaucugcacccgggaggaguucacccgcaaggugcggagcaacgccgccaucggcgcggucuucguggacgagaaccaguggaacagcgccaaggaggccguggaggacgagcgcuucugggaccugguccaccgggagcgcgagcuccacaagcaggggaagugcgccacgugcguguacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacaccgcgggcugggacacccgcaucaccgaggacgaccuccagaacgaggccaagaucacggacaucauggagcccgagcacgcccugcuggccaccagcaucuucaagcucaccuaccagaacaaggucgugcgcgugcagcggcccgccaagaacgggaccgucauggacgugaucucccgccgggaccagcgcggcagcggccagguggggacguacggccugaacaccuucaccaacauggagguccagcugauccggcagauggaguccgaggggaucuuccuccccagcgagcuggagaccccgaaccuggcggagcgcgugcucgacuggcuggagaagcacggcgccgagcggcugaagcgcauggccaucuccggggacgacugcguggucaagcccaucgacgaccgguucgccacggcccucaccgcgcugaacgacaugggcaaggugcgcaaggacaucccccagugggagcccagcaagggcuggaacgacuggcagcaggucccguucugcucccaccacuuccaccagcugaucaugaaggacgggcgggagaucgucgugcccugccgcaaccaggacgagcucgugggccgggcccgcgucagccagggggccggcuggucccugcgggagaccgccugccugggcaagagcuacgcccagauguggcagcucauguacuuccaccgccgggaccugcgccuggcggccaacgccaucugcuccgccgugcccguggacuggguccccaccagccggaccacguggagcauccacgcgcaccaccaguggaugaccaccgaggacaugcucuccguguggaaccgcguguggaucgaggagaacccguggauggaggacaagacccacgucagcuccugggaggaggugcccuaccugggcaagcgcgaggaccaguggugcggcagccugaucgggcucacggcccgggccaccugggccaccaacauccagguggccaucaaccagguccgccggcugaucggcaacgagaacuacaucgacuacaugaccuccaugaagcgcuucaagaacgagagcgaccccgagggggcgcugugguga

SEQ ID NO: 7972 - RNA, 9879 nt, Artificial Sequence
  derived and/or modified CDS sequence (opt1) from DENV-1__GQ868561__SS-prME
agcgugaccaugcugcucaugcugcugcccaccgcgcucgccuuccaccugaccacccgcggcggggagccccacaugaucgugagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgccuucuuccuggcgcacgccaucggcaccagcaucacccagaaggggaucaucuucauccuccugaugcuggugacccccuccauggccaugcggugcgucggcaucggcaaccgcgacuucguggaggggcucagcggcgccacguggguggacgucgugcuggagcacggguccugcgugaccaccauggccaagaacaagcccacccuggacaucgagcuccugaagacggaggucaccaaccccgcggugcugcggaagcucugcaucgaggccaagaucagcaacaccaccacggacucccgcugcccgacccagggcgaggccacccugguggaggagcaggacgccaacuucgucugccggcgcaccuucguggaccggggcugggggaacggcugcgggcuguucggcaaggggagccuccugacgugcgccaaguucaagugcgugaccaagcuggagggcaagaucguccaguacgagaaccucaaguacuccgugaucgugaccguccacaccggcgaccagcaccagguggggaacgagacgaccgagcacggcaccaucgcgaccaucacgccccaggcccccacgagcgagauccagcugaccgacuacggggcccugacccucgacugcagcccccgcaccggccuggacuucaacgagaugguccugcucacgaugaaggagaaguccuggcuggugcacaagcagugguuccuggaccucccgcugcccuggaccuccggggccagcaccagccaggagaccuggaaccggcaggaccugcucgugacguucaagaccgcccacgcgaagaagcaggaggucguggugcugggcucccaggagggcgccaugcacaccgcccugaccggggccacggagauccagaccagcggcaccaccacgaucuucgccgggcaccucaagugccgccugaagauggacaagcugacccucaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcugaucacggccaacccgaucgucaccgacaaggagaagcccgugaacaucgagaccgagccgcccuucggggagagcuacaucguggucggcgccggcgagaaggcgcucaagcuguccugguucaagaaggggagcuccaucggcaagauguucgaggccaccgcccgcggggcccggcgcauggccauccugggcgacacggcgugggacuucgggagcaucggcggcguguucaccuccguggggaagcucguccaccagguguucggcaccgccuacggggugcuguucagcggcgucuccuggaccaugaagaucgggaucggcauccugcucacguggcugggccugaacagccgcuccaccagccucuccaugaccugcaucgccguggggauggugacccuguaccugggcgucauggugcaggccgacagcgggugcgugaucaacuggaagggccgggagcucaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccuggagaacaucauguggaagcagaucagcaacgagcucaaccacauccugcuggagaacgacaugaaguucaccgucguggugggggacgccaacggcauccucgcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcugcgggacuccuacacccagaugugcgaccaccgccucaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccugugguccaacgggguccucgagagcgagaugaucauccccaagaucuacggcgggccgaucucccagcacaacuaccgccccggcuacuucacccagaccgccgggcccuggcaccugggcaagcuggagcucgacuucgaccugugcgagggcacgaccgugguggucgacgagcacugcgggaaccggggcccgagccugcgcaccaccacggugaccgggaagaucauccacgaguggugcugccgguccugcacccugccgccccugcgcuuccggggcgaggacgggugcugguacggcauggagauccgccccgugaaggagaaggaggagaaccugguccggagcaugguguccgccggcagcggggagguggacagcuucucccucggcauccugugcgucagcaucaugaucgaggaggugaugcgcucccgguggagccgcaagaugcugaugaccgggacgcucgccguguuccugcugcucaucaugggccagcugaccuggaacgaccugauccgccucugcaucauggucggggccaacgcguccgaccggaugggcaugggcaccaccuaccuggcccugauggccacguucaagaugcgcccgauguucgccguggggcuccuguuccggcgccugaccagccgggaggugcuccugcugaccaucggccucucccuggucgccagcguggagcugcccaacucccucgaggagcugggggacggccuggcgaugggcaucaugaugcucaagcugcugaccgaguuccagccccaccagcucuggacgacccugcugagccucaccuucgucaagaccacgcugucccuggacuacgccuggaagaccaccgccauggugcucagcaucgugucccuguucccccugugccucagcaccacgucccagaagaccaccuggcugccgguccugcucgggagcuucggcugcaagccccugaccauguuccugaucaccgagaacaagaucugggggcgcaaguccuggccccucaacgagggcaucauggccaucgggaucgugagcauccugcuguccagccuccugaagaacgacgugccccuggcgggcccgcucaucgccggcgggaugcugaucgccugcuacgucaucagcggcuccagcgccgaccugucccucgagaaggccgcggaggugagcugggagcaggaggccgagcacuccggggccagccacaacauccugguggagguccaggacgacggcacgaugaagaucaaggacgaggagcgggacgacacccugaccauccuccugaaggccacccugcucgccguguccgggguguaccccaugagcauccccgcgacgcuguucgucugguacuucuggcagaagaagaagcagcgcuccggcgugcugugggacacccccagcccgcccgagguggagcgggccguccucgacgacggcaucuaccgcauccugcagcgggggcugcugggccgcucccaggugggggugggcgucuuccaggacgggguguuccacaccauguggcacgugacccggggcgccguccucauguaccagggcaagcgccuggagcccagcugggccuccgugaagaaggaccugaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccucgacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccugcccgagaucgaggacgaggucuucaagaagcggaaccucaccaucauggaccugcacccgggcagcggcaagacccgccgguaccugcccgccaucgugcgcgaggccaucaagcggaagcuccgcacccugauccuggcccccacgcgcguggucgcguccgagauggccgaggcccucaaggggaugcccauccgguaccagaccaccgccgucaagagcgagcacaccggccgcgagaucguggaccugaugugccacgccacguucaccaugcggcugcucuccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcugagccggaagacguucgacaccgaguaccagaagaccaagaacaacgacugggacuacguggucaccacggacaucuccgagaugggcgccaacuuccgcgccgaccgggugaucgacccccgccggugccucaagcccgugauccugaaggacgggcccgagcgcgucauccuggccggcccgaugcccgugaccgucgcgagcgccgcccagcggcgcggccggaucgggcgcaaccagaacaaggagggcgaccaguacguguacauggggcagccccucaacaacgacgaggaccacgcccacuggaccgaggccaagaugcugcuggacaacaucaacacccccgagggcaucaucccggcccucuucgagcccgagcgcgagaaguccgccgccaucgacggggaguaccggcugcgcggcgaggcccggaagacguucguggagcugaugcgccggggcgaccuccccgucuggcugagcuacaagguggccuccgagggguuccaguacagcgaccgccgguggugcuucgacggcgagcgcaacaaccaggugcuggaggagaacauggacgucgagaucuggaccaaggagggggagcggaagaagcuccgcccccgguggcuggacgcgcgcaccuacuccgacccgcuggcccuccgggaguucaaggaguucgccgccggccgccggagcgugagcggcgaccugauccuggagaucgggaagcucccccagcaccugacccugcgcgcccagaacgcgcucgacaaccuggugaugcugcacaacuccgagcagggcgggaaggccuaccggcacgccauggaggagcuccccgacaccaucgagacgcugaugcugcucgcccugaucgcgguccugaccggcggggugacccucuucuuccugagcggcaagggccuggggaagaccuccaucggccuccugugcgugacggccagcuccgcccugcucuggauggccagcgucgagccccacuggaucgccgcguccaucauccuggaguucuuccugauggugcuccugaucccggagcccgaccgccagcggacgccccaggacaaccagcuggccuacguggucaucgggcuccuguucaugauccugaccguggccgccaacgagaugggccuccuggagaccacgaagaaggaccuggggaucggcuacguggccgcggagaaccaccagcacgccaccaugcucgacgucgaccugcgcccggccagcgccuggacccuguacgccguggcgaccacggugaucacccccaugaugcggcacaccaucgagaacaccacggccaacaucucccucaccgccaucgccaaccaggccgcgauccugaugggccuggacaagggguggcccaucagcaagauggacaucggcgucccccuccuggcccuggggugcuacucccaggugaacccgcucacccugaccgccgccgugcugaugcucgucgcgcacuacgccaucaucggccccgggcugcaggccaaggccacgcgcgaggcccagaagcgcaccgcggccggcaucaugaagaaccccaccguggacggcaucguggccaucgaccuggaccccgucguguacgacgccaaguucgagaagcagcucgggcagaucaugcugcugauccucugcaccagccagauccugcugaugcggacgaccugggcccucugcgaguccaucacccuggcgaccggcccgcugacgacccucugggaggggagccccggcaaguucuggaacaccaccaucgccguguccauggccaacaucuuccgcggcagcuaccuggccggggccggccuggcguucucccucaugaagucccucgggggcgggcggcgcggcacgggcgcccagggggagacccugggcgagaaguggaagcggcagcucaaccagcuguccaagagcgaguucaacaccuacaagcgcagcgggaucauggaggucgaccgguccgaggccaaggagggccugaagcgcggggagaccacgaagcacgccgugagccggggcaccgcgaagcuccgcugguucguggagcggaaccuggucaagcccgagggcaaggugaucgaccuggggugcggccgcgggggcugguccuacuacugcgccgggcugaagaaggugaccgaggucaagggcuacaccaagggcgggcccggccacgaggagccgauccccauggccaccuacggguggaaccucgugaagcugcacagcggcaaggacguguucuucaugccgcccgagaagugcgacacgcugcucugcgacaucggggaguccagcccgucccccaccaucgaggagggccggacccugcgcguccugaagaugguggagcccuggcuccggggcaaccaguucugcaucaagauccugaaccccuacaugccgagcguggucgagacccuggagcagaugcagcgcaagcacgggggcaugcucgugcggaacccccugucccgcaacagcacgcacgagauguacuggguguccugcgggaccggcaacaucgucagcgccgugaacaugaccucccggaugcugcucaaccgcuucaccauggcccaccgcaagcccacguacgagcgggacguggaccugggcgcggggacccgccacgucgccguggagcccgagguggccaaccuggacaucaucggccagcggaucgagaacaucaagaacgagcacaagagcaccuggcacuacgacgaggacaacccguacaagaccugggccuaccacggguccuacgaggucaagcccagcggcuccgccagcuccauggugaacggggucgugcgccuccugacgaagcccugggacgugauccccauggucacccagaucgcgaugaccgacaccacgccguucggccagcagcggguguucaaggagaagguggacacccgcacgccccgggccaagcgcggcaccacgcagaucauggaggucaccgccaaguggcuguggggguuccucagccggaacaagaagccccgcaucugcacccgggaggaguucacccgcaaggugcggagcaacgccgccaucggcgcgguguucgucgacgagaaccaguggaacuccgccaaggaggccguggaggacgagcgcuucugggaccuggugcaccgggagcgcgagcugcacaagcaggggaagugcgccacgugcgucuacaacaugaugggcaagcgggagaagaagcucggggaguucggcaaggcgaagggcagccgcgccaucugguacauguggcugggggcccgguuccuggaguucgaggcccucggcuucaugaacgaggaccacugguucucccgcgagaacagccuguccgggguggagggcgaggggcugcacaagcucggcuacauccugcgggacaucagcaagaucccgggcgggaacauguacgccgacgacaccgcgggcugggacacccgcaucaccgaggacgaccugcagaacgaggccaagaucacggacaucauggagcccgagcacgcccuccuggccaccuccaucuucaagcugaccuaccagaccaaggugguccgcgugcagcggcccgccaagaacgggacggugauggacgucaucagccgccgggaccagcgcggcuccggccagguggggaccuacggccucaacaccuucaccaacauggaggugcagcugauccggcagauggagagcgaggggaucuuccugcccuccgagcucgagacgccgaaccuggcggagcgcguccuggacuggcucgagaagcacggcgccgagcggcugaagcgcauggccaucagcggggacgacugcguggugaagcccaucgacgaccgguucgccaccgcccugaccgcgcucaacgacaugggcaagguccgcaaggacaucccccagugggagcccuccaagggcuggaacgacuggcagcaggucccguucugcagccaccacuuccaccagcugaucaugaaggacgggcgggagaucgugguccccugccgcaaccaggacgagcuggugggccgggcccgcgugucccagggggccggcuggagccuccgggagaccgccugccuggggaaguccuacgcccagauguggcagcugauguacuuccaccgccgggaccuccgccuggcggccaacgccaucugcagcgccguccccguggacugggugcccaccagccggacgaccugguccauccacgcgcaccaccaguggaugaccaccgaggacaugcugagcgucuggaaccgcguguggaucgaggagaacccguggauggaggacaagacgcacguguccagcugggaggagguccccuaccucggcaagcgcgaggaccaguggugcggcucccugaucgggcugaccgcccgggccaccugggccaccaacauccagguggccaucaaccaggugcgccggcucaucggcaacgagaacuaccuggacuacaugacgagcaugaagcgcuucaagaacgaguccgaccccgagggggcgcugugguga

SEQ ID NO: 7973 - RNA, 9879 nt, Artificial Sequence
  derived and/or modified CDS sequence (opt1) from DENV-1__GU131948__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugccccacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccaccuaccuggcccucauggccacguucaagaugcgcccgauguucgccguggggcugcuguuccggcgccucaccagccgggagauccugcugcucaccaucgggcugucccugguggccagcgucgagcuccccaacucccuggaggagcugggggacggccucgcgaugggcaucaugaugcugaagcugcucaccgaguuccagccccaccagcuguggacgacccugcucagccugaccuucgugaagaccacgcugucccucgacuacgccuggaagaccaccgccaugguccugagcaucgugucccuguucccccucugccugagcaccacgucccagaagaccaccuggcugccggugcuccuggggagcuucggcugcaagccccugaccauguuccucaucaccgagaacaagaucugggggcgcaaguccuggccccugaacgagggcaucauggccaucgggaucgucagcauccugcucuccagccugcugaagaacgacgugccccucgcgggcccgcugaucgccggcgggaugcugaucgccugcuacgugaucagcggcuccagcgccgaccucucccuggagaaggccgcggaggucagcugggagcaggaggccgagcacuccggggccagccacaacauccugguggaggugcaggacgacggcacgaugaagaucaaggacgaggagcgggacgacacccucaccauccugcugaaggccacccuccuggccgucuccgggguguaccccaugagcauccccgcgacgcuguucgugugguacuucuggcagaagaagaagcagcgcuccggcguccucugggacacccccagcccgcccgagguggagcgggccgugcuggacgacggcaucuaccgcauccugcagcgggggcugcucggccgcucccaggucggggugggcguguuccaggacggggucuuccacaccauguggcacgugacccggggcgccgugcugauguaccagggcaagcgccuggagcccagcugggccuccgucaagaaggaccucaucagcuacgggggcggguggcgguuccagggcuccuggaacacgggggaggagguccaggugaucgccgucgagcccggcaagaacccgaagaacgugcagaccacccccggcaucuucaagacccccgagggggaggugggcgcgaucgcccuggacuucaagcccgggacgagcggcuccccgaucgucaaccgcgagggcaagaucguggggcuguacggcaacgggguggucaccaccagcggcaccuacguguccgccaucgcccaggccaaggcgagccaggaggggccccuccccgagaucgaggacgagguguucaagaagcggaaccugacgaucauggaccugcacccgggcagcggcaagacccgccgguaccuccccgccaucguccgcgaggccaucaagcggaagcugcgcacccugauccucgcccccacccgcgugguggcguccgagauggccgaggcccugaaggggaugcccauccgguaccagacgaccgccgucaagagcgagcacaccggccgcgagaucguggaccugaugugccacgccaccuucacgaugcggcuccuguccccggugcgcguccccaacuacaacaugaucaucauggacgaggcgcacuucaccgaccccgccagcaucgccgcccggggguacaucuccacccgcgugggcaugggggaggccgcggccaucuucaugaccgccacgcccccgggcagcguggaggccuucccccaguccaacgccgucauccaggacgaggagcgggacauccccgagcgcagcuggaacuccggcuacgacuggaucaccgacuuccccgggaagaccgugugguucgugccgagcaucaaguccggcaacgacaucgcgaacugccugcggaagaacgggaagcgcgucauccagcucagccggaagaccuucgacacggaguaccagaagaccaagaacaacgacugggacuacguggugaccaccgacaucuccgagaugggcgccaacuuccgcgccgaccgggucaucgacccccgccggugccugaagcccgugauccugaaggacgggcccgagcgcgugauccucgccggcccgaugcccgucacgguggcgagcgccgcccagcggcgcggccggaucgggcgcaaccagaacaaggagggcgaccaguacgucuacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagaccuucguggagcucaugcgccggggcgaccugcccguguggcugagcuacaaggucgccuccgagggguuccaguacagcgaccgccgguggugcuucgacggcgagcgcaacaaccaggugcucgaggagaacauggacguggagaucuggacgaaggagggggagcggaagaagcugcgcccccgguggcuggacgcgcgcaccuacuccgacccgcucgcccugcgggaguucaaggaguucgccgccggccgccggagcaucagcggcgaccugauccucgagaucgggaagcugccccagcaccugacccuccgcgcccagaacgcgcuggacaaccuggucaugcuccacaacuccgagcagggcgggaaggccuaccggcacgccauggaggagcugcccgacaccaucgagacccugaugcuccuggcccugaucgcggugcucacgggcggggugacccuguucuuccugagcggcaagggccucgggaagaccuccaucggccugcugugcgucaccgccagcuccgcccuccuguggauggccagcguggagccccacuggaucgccgcguccaucauccuggaguucuuccucauggugcugcugaucccggagcccgaccgccagcggacgccccaggacaaccagcucgccuacgucgugaucgggcugcuguucaugauccucaccguggccgccaacgagaugggccugcuggagaccaccaagaaggaccucgggaucggcuacgucgccgcggagaaccaccagcacgccacgaugcuggacguggaccugcgcccggccagcgccuggacccucuacgccguggcgaccaccgucaucacgcccaugaugcggcacaccaucgagaacaccaccgccaacaucucccugacggccaucgccaaccaggccgcgauccugaugggccucgacaagggguggcccaucagcaagauggacaucggcgugccccugcuggcccucgggugcuacucccaggugaacccgcugacccugaccgccgccguccucaugcugguggcgcacuacgccaucaucggccccgggcugcaggccaaggccacccgcgaggcccagaagcgcacggcggccggcaucaugaagaaccccaccguggacggcaucgucgccaucgaccucgaccccgugguguacgacgccaaguucgagaagcagcuggggcagaucaugcugcucauccugugcaccagccagauccugcucaugcggaccacgugggcccugugcgaguccaucacccuggcgaccggcccgcucaccacgcugugggaggggagccccggcaaguucuggaacaccaccaucgccgucuccauggccaacaucuuccgcggcagcuaccuggccggggccggccucgcguucucccugaugaagucccucgggggcgggcggcgcgggaccggcgcccagggggagacgcucggcgagaaguggaagcggcagcugaaccagcuguccaagagcgaguucaacaccuacaagcgcagcgggaucauggagguggaccgguccgaggccaaggagggccucaagcgcggggagaccaccaagcacgccgugagccggggcacggcgaagcugcgcugguucgucgagcggaaccuggugaagcccgagggcaaggugaucgaccuggggugcggccgcgggggcugguccuacuacugcgccgggcucaagaaggucaccgaggugaagggcuacaccaagggcgggcccggccacgaggagccgauccccauggccaccuacggguggaaccuggugaagcugcacagcggcaaggacgucuucuucaugccgcccgagaagugcgacacccuccugugcgacaucggggaguccagcccgaaccccacgaucgaggagggccggacccugcgcgugcucaagaugguggagcccuggcugcggggcaaccaguucugcaucaagauccugaaccccuacaugccguccgucguggagacccucgagcagaugcagcgcaagcacgggggcaugcuggugcggaacccccugagccgcaacuccacccacgagauguacugggucagcugcgggacgggcaacaucguguccgccgugaacaugaccagccggaugcuccugaaccgcuucaccauggcccaccgcaagcccaccuacgagcgggacgucgaccugggcgcggggacgcgccacguggccguggagcccgaggucgccaaccucgacaucaucggccagcggaucgagaacaucaagaacgagcacaaguccaccuggcacuacgacgaggacaacccguacaagaccugggccuaccacgggagcuacgaggugaagcccuccggcagcgccuccagcauggugaacggggucgugcgccugcugaccaagcccugggacgucauccccauggugacgcagaucgcgaugaccgacaccaccccguucggccagcagcggguguucaaggagaaggucgacacgcgcacgccccgggccaagcgcggcaccacccagaucauggaggugacggccaaguggcucuggggguuccugucccggaacaagaagccccgcaucugcacccgggaggaguucacccgcaaggugcggagcaacgccgccaucggcgcggucuucguggacgagaaccaguggaacagcgccaaggaggccguggaggacgagcgcuucugggaccugguccaccgggagcgcgagcuccacaagcaggggaagugcgcgaccugcguguacaacaugaugggcaagcgggagaagaagcugggggaguucggcaaggcgaagggcucccgcgccaucugguacauguggcugggggcccgguuccucgaguucgaggcccugggcuucaugaacgaggaccacugguucagccgcgagaacucccugagcgggguggagggcgaggggcuccacaagcugggcuacauccugcgggacaucuccaagaucccgggcgggaacauguacgccgacgacacggcgggcugggacacccgcaucaccgaggacgaccuccagaacgaggccaagaucaccgacaucauggagcccgagcacgcccugcuggccacgagcaucuucaagcucaccuaccagaacaaggucgugcgcgugcagcggcccgccaagaacgggaccgucauggacgugaucucccgccgggaccagcgcggcagcggccagguggggaccuacggccugaacacguucaccaacauggagguccagcugauccggcagauggaguccgaggggaucuuccuccccagcgagcuggagaccccgaaccuggcggagcgcgugcucgacuggcuggagaagcacggcgccgagcggcugaagcgcauggccaucuccggggacgacugcguggucaagcccaucgacgaccgguucgccaccgcccucacggcgcugaacgacaugggcaaggugcgcaaggacacgccccagugggagcccagcaagggcuggaacgacuggcagcaggucccguucugcucccaccacuuccaccagcugaucaugaaggacgggcgggagaucgucgugcccugccgcaaccaggacgagcucgugggccgggcccgcgucagccagggggccggcuggucccugcgggagaccgccugccugggcaagagcuacgcccagauguggcagcucauguacuuccaccgccgggaccugcgccuggcggccaacgccaucugcuccgccgugcccguggacuggguccccaccagccggaccacguggagcauccacgcgcaccaccaguggaugaccaccgaggacaugcucuccguguggaaccgcguguggaucgaggagaacccguggauggaggacaagacccacgucagcuccugggaggaggugcccuaccugggcaagcgcgaggaccaguggugcggcagccugaucgggcucacggcccgggccaccugggccaccaacauccagguggccaucaaccagguccgccggcugaucggcaacgagaacuaccuggacuacaugaccuccaugaagcgcuucaagaacgagagcgaccccgagggggcgcucugguga

SEQ ID NO: 7974 - RNA, 9879 nt, Artificial Sequence
  derived and/or modified CDS sequence (opt1) from DENV-1__GQ868562__SS-prME
agcgugaccaugcugcucaugcugcugcccaccgcccucgccuuccaccugaccacccgcggcggggagccccacaugaucgugagcaagcaggagcggggcaagagccugcuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccucuucggcaaggggagccugcugacgugcgccaaguucaagugcgugaccaagcucgagggcaagaucguccagcacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacacgaccuucaucaucgacgggcccgacaccccggagugccccgacggccagcgcgccuggaacaucugggaggucgaggacuacggguucggcaucuucaccacgaacaucuggcugaagcuccgggacuccuacacccagaugugcgaccaccgccugaugagcgcggccaucaaggacuccaaggccgugcacgccgacaugggcuacuggaucgagagcgagaagaacgagaccuggaagcuggcccgggcguccuucaucgaggugaagaccugcacguggcccaagagccacacccucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcacgaccgugguggucgacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacgcuggccguguuccugcuccugaucaugggccagcugaccuggaacgaccucauccgccugugcaucauggucggggccaacgcguccgaccggaugggcaugggcaccacccaccuggcccucauggccacguucaagaugcgcccgauguucgccguggggcugcuguuccggcgccucaccagccgggaggugcugcugcucaccaucgggcugucccuggucgccagcguggagcuccccaacucccuggaggagcugggggacggccucgcgaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgcgggcccgcugaucgccggcgggaugcugaucgccugcuacgucaucagcggcuccagcgccgaccucucccuggagaaggccgcggaggugagcugggagcaggaggccgagcacuccggggccagccacaacauccugguggagguccaggacgacggcacgaugaagaucaaggacgaggagcgggacgacacccucaccauccugcugaaggccacccuccuggccguguccgggguguaccccaugagcauccccgcgacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggcuccuggaacacgggggaggaggugcaggucaucgccguggagcccggcaagaacccgaagaacgugcagaccacccccggcaccuucaagacgcccgagggggaggucggcgcgaucgcccuggacuucaagcccgggaccagcggcuccccgaucgugaaccgcgagggcaagaucguggggcuguacggcaacggggucgugaccaccagcggcacguacguguccgccaucgcccaggccaaggcgagccaggaggggccccuccccgagaucgaggacgaggucuucaagaagcggaaccugaccaucauggaccugcacccgggcagcggcaagacccgccgguaccuccccgccaucgugcgcgaggccaucaagcggaagcugcgcacccugauccucgcccccacgcgcguggucgcguccgagauggccgaggcccugaaggggaugcccauccgguaccagaccaccgccgucaagagcgagcacaccggccgcgagaucguggaccugaugugccacgccacguucaccaugcggcuccuguccccgguccgcgugcccaacuacaacaugaucaucauggacgaggcgcacuucaccgaccccgccagcaucgccgcccggggguacaucuccacccgcgugggcaugggggaggccgcggccaucuucaugacggccacgccgcccggcagcgucgaggccuucccccaguccaacgccgugauccaggacgaggagcgggacauccccgagcgcagcuggaacuccggcuacgacuggaucaccgacuuccccgggaagaccgugugguucguccccagcaucaaguccggcaacgacaucgcgaacugccugcggaagaacgggaagcgcgugauccagcucagccggaagacguucgacaccgaguaccagaagaccaagaacaacgacugggacuacguggucaccacggacaucuccgagaugggcgccaacuuccgcgccgaccgggugaucgacccccgccggugccugaagcccgugauccugaaggacgggcccgagcgcgucauccucgccggcccgaugcccgugaccgucgcgagcgccgcccagcggcgcggccggaucgggcgcaaccagaacaaggagggcgaccaguacguguacauggggcagccccugaacaacgacgaggaccacgcccacuggaccgaggccaagaugcugcucgacaacaucaacacccccgagggcaucaucccggcgcuguucgagcccgagcgcgagaaguccgccgccaucgacggggaguaccggcugcgcggcgaggcccggaagacguucguggagcucaugcgccggggcgaccugcccgucuggcugagcuacaagguggccuccgagggguuccaguacagcgaccgccgguggugcuucgacggcgagcgcaacaaccaggugcucgaggagaacauggacgucgagaucuggaccaaggagggggagcggaagaagcugcgcccccgguggcuggacgcgcgcaccuacuccgacccgcucgcccugcgggaguucaaggaguucgccgccggccgccggagcgugagcggcgaccugauccucgagaucgggaagcugccccagcaccugacccuccgcgcccagaacgcgcuggacaaccuggugaugcuccacaacuccgagcagggcgggaaggccuaccggcacgccauggaggagcugcccgacaccaucgagacgcugaugcuccuggcccugaucgcgguccucaccggcggggccacccuguucuuccugagcggcaagggccucgggaagaccuccaucggccugcugugcgugacggccagcuccgcccuccuguggauggccagcguggagccccacuggaucgcggccuccaucauccuggaguucuuccucaugguccugcugaucccggagcccgaccgccagcggacgccccaggacaaccagcucgccuacguggugaucgggcugcuguucaugauccucaccgucgccgccaacgagaugggccugcuggagaccacgaagaaggaccucgggaucggcuacguggcggccgagaaccaccagcacgccaccaugcuggacguggaccugcgcccggccagcgccuggacccucuacgcggucgccaccacggugaucacccccaugaugcggcacaccaucgagaacaccacggccaacaucucccugaccgccaucgccaaccaggcggccauccugaugggccucgacaagggguggcccaucagcaagauggacaucggcgugccccugcuggcccucgggugcuacucccaggucaacccgcugacccugaccgccgcggugcucaugcugguggcccacuacgccaucaucggccccgggcugcaggccaaggccacgcgcgaggcgcagaagcgcaccgccgccggcaucaugaagaaccccaccgucgacggcaucguggccaucgaccucgaccccguggucuacgacgccaaguucgagaagcagcuggggcagaucaugcugcucauccugugcaccagccagauccugcucaugcggacgaccugggcgcugugcgaguccaucacccuggccaccggcccgcucacgacccugugggaggggagccccggcaaguucuggaacaccaccaucgccguguccauggccaacaucuuccgcggcagcuaccuggccggggcgggccucgccuucucccugaugaagucccucgggggcgggcggcgcgggacgggcgcccagggggagacccucggcgagaaguggaagcggcagcugaaccagcuguccaagagcgaguucaacaccuacaagcgcagcgggaucauggagguggaccgguccgaggccaaggagggccucaagcgcggggagaccacgaagcacgcggucagccggggcaccgccaagcugcgcugguucguggagcggaaccuggugaagcccgagggcaaggucaucgaccuggggugcggccgcgggggcugguccuacuacugcgccgggcucaagaaggugaccgaggugaagggcuacaccaagggcgggcccggccacgaggagccgauccccauggccaccuacggguggaaccuggucaagcugcacagcggcaaggacguguucuucaugccgcccgagaagugcgacacgcuccugugcgacaucggggaguccagcccgaaccccaccaucgaggagggccggacccugcgcgugcucaagauggucgagcccuggcugaagggcaaccaguucugcaucaagauccugaaccccuacaugccguccgugguggagacccucgagcagaugcagcggaagcacgggggcaugcugguccgcaacccccugagccggaacuccacgcacgagauguacugggugagcugcgggaccggcaacaucguguccgccgucaacaugaccagccgcaugcuccugaaccgguucaccauggcgcaccgcaagcccacguacgagcgcgacguggaccugggcgccgggacccggcacguggccgucgagcccgagguggccaaccucgacaucaucggccagcgcaucgagaacaucaagaacgagcacaaguccaccuggcacuacgacgaggacaacccguacaagaccugggccuaccacgggagcuacgaggugaagcccuccggcagcgcguccagcauggucaacggggugguccggcugcugacgaagcccugggacgugauccccauggugacccagaucgccaugaccgacaccacgccguucggccagcagcgcgucuucaaggagaagguggacacccggacgccccgcgccaagcggggcaccacgcagaucauggaggugaccgccaaguggcucuggggguuccugucccgcaacaagaagccccggaucugcacccgcgaggaguucacccggaagguccgcagcaacgccgcgaucggcgccguguucguggacgagaaccaguggaacagcgccaaggaggccgucgaggacgagcgguucugggaccuggugcaccgcgagcgggagcuccacaagcaggggaagugcgcgacgugcguguacaacaugaugggcaagcgcgagaagaagcugggggaguucggcaaggccaagggcucccgggccaucugguacauguggcugggggcccgcuuccucgaguucgaggcccugggcuucaugaacgaggaccacugguucagccgggagaacucccugagcggggucgagggcgaggggcuccacaagcugggcuacauccugcgcgacaucuccaagaucccgggcgggaacauguacgcggacgacaccgccggcugggacacccggaucaccgaggacgaccuccagaacgaggccaagaucacggacaucauggagcccgagcacgcccugcuggccaccagcaucuucaagcucaccuaccagaacaagguggugcgcguccagcgccccgcgaagaacgggaccgugauggacgugaucucccggcgcgaccagcggggcagcggccaggucgggacguacggccugaacaccuucaccaacauggaggugcagcugauccgccagauggaguccgaggggaucuuccuccccagcgagcuggagaccccgaaccuggccgagcgggugcucgacuggcuggagaagcacggcgccgagcgccugaagcggauggccaucuccggggacgacugcgucgugaagcccaucgacgaccgcuucgccacggcgcucaccgcccugaacgacaugggcaaggugcggaaggacaucccccagugggagcccagcaagggcuggaacgacuggcagcaggucccguucugcucccaccacuuccaccagcugaucaugaaggacgggcgcgagaucguggugcccugccggaaccaggacgagcucgucggccgcgcccgggugagccagggggccggcuggucccugcgcgagaccgccugccugggcaagagcuacgcgcagauguggcagcucauguacuuccaccggcgcgaccugcggcuggccgccaacgccaucugcuccgcggugcccgucgacugggugcccaccagccgcaccacguggagcauccacgcccaccaccaguggaugaccaccgaggacaugcucuccguguggaaccgggucuggaucgaggagaacccguggauggaggacaagacccacgugagcuccugggaggaggugcccuaccugggcaagcgcgaggaccaguggugcggcagccugaucgggcucacggcccgcgccaccugggccaccaacauccaggucgcgaucaaccaggugcggcgccugaucggcaacgagaacuaccuggacuacaugaccuccaugaagcgguucaagaacgagagcgaccccgagggggcccucugguga

SEQ ID NO: 7975 - RNA, 9879 nt, Artificial Sequence
  derived and/or modified CDS sequence (opt1) from DENV-1__GQ868563__SS-prME
agcgugaccaugcugcucaugcugcugcccaccgcccucgccuuccaccugaccacccgcggcggggagccccacaugaucgucagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacgccacguucaucaucgacgggcccgacaccccggagugccccgacggccagcgcgcguggaacaucugggaggucgaggacuacggguucggcaucuucaccaccaacaucuggcugaagcuccgggacuccuacacgcagaugugcgaccaccgccugaugagcgccgccaucaaggacuccaaggccgugcacgccgacaugggcuacuggaucgagagcgagaagaacgagaccuggaagcuggcgcgggccuccuucaucgaggugaagaccugcaccuggcccaagagccacacgcucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcaccacggugguggucgacgagcacugcgggaaccggggcccgagccuccgcaccaccaccgugacggggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacccuggccguguuccugcuccugaucaugggccagcugacguggaacgaccucacccgccugugcaucauggucggggcgaacgccuccgaccggaugggcaugggcaccaccuaccuggcccucauggccacguucaagaugcgcccgauguucgccguggggcugcuguuccggcgccucaccagccgggaggugcugcugcucaccaucgggcugucccuggucgcgagcguggagcuccccaacucccuggaggagcugggggacggccucgccaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggcgaucgggaucgugagcauccugcucuccagccugcugaagaacgacgugccccucgccggcccgcugaucgccggcgggaugcugaucgccugcuacgucaucagcggcuccagcgccgaccucucccuggagaaggcggccgaggugagcugggagcaggaggccgagcacuccggggccagccacaacauccugguggagguccaggacgacggcacgaugaagaucaaggacgaggagcgggacgacacccucaccauccugcugaaggccacccuccuggcgguguccgggguguaccccaugagcauccccgccacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggccuguggaacacgggggaggaggugcaggucaucgcgguggagcccggcaagaacccgaagaacgugcagaccacccccggcaccuucaagacgcccgagggggaggucggcgccaucgcccuggacuucaagcccgggaccuccggcagcccgaucgugaaccgcgagggcaagaucguggggcucuacggcaacggggucgugaccaccuccggcacguacgugagcgccaucgcccaggcgaaggccucccaggaggggccccugcccgagaucgaggacgaggucuucaagaagcggaaccugaccaucauggaccuccacccgggcagcggcaagacccgccgguaccugcccgccaucgugcgcgaggccaucaagcggaagcugcgcacccucauccuggcgcccacgcgcguggucgccagcgagauggccgaggcccugaaggggaugcccauccgguaccagaccaccgccgugaaguccgagcacaccggccgcgagaucguggaccucaugugccacgcgacguucaccaugcggcugcugagcccgguccgcgugcccaacuacaacaugaucaucauggacgaggcccacuucaccgaccccgccuccaucgccgcccggggguacaucagcacccgcgugggcaugggggaggcggccgccaucuucaugacggccacgccgcccggcuccgucgaggccuucccccagagcaacgcggugauccaggacgaggagcgggacauccccgagcgcuccuggaacagcggcuacgacuggaucaccgacuuccccgggaagaccgugugguucguccccuccaucaagagcggcaacgacaucgccaacugccuccggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccucaaggacgggcccgagcgcgucauccuggcgggcccgaugcccgugaccgucgccuccgccgcccagcggcgcggccggaucgggcgcaaccagaacaaggagggcgaccaguacguguacauggggcagccccugaacaacgacgaggaccacgcccacuggaccgaggcgaagaugcuccuggacaacaucaacacccccgagggcaucaucccggcccuguucgagcccgagcgcgagaaguccgccgccaucgacggggaguaccggcuccgcggcgaggcccggaagacguucguggagcugaugcgccggggcgaccugcccgucuggcucuccuacaagguggcgagcgagggguuccaguacuccgaccgccgguggugcuucgacggcgagcgcaacaaccaggugcuggaggagaacauggacgucgagaucuggaccaaggagggggagcggaagaagcugcgcccccgguggcucgacgcccgcaccuacagcgacccgcuggcccugcgggaguucaaggaguucgccgccggccgccgguccgugagcggcgaccucauccuggagaucgggaagcugccccagcaccucacccugcgcgcgcagaacgcccuggacaaccucgugaugcugcacaacagcgagcagggcgggaaggccuaccggcacgccauggaggagcugcccgacaccaucgagacgcucaugcugcuggcgcucaucgccguccugaccggcggggugacccuguucuuccucuccggcaagggccuggggaagaccagcaucggccugcucugcgugacggccuccagcgcccugcuguggauggccuccgucgagccccacuggaucgcggccagcaucauccucgaguucuuccugauggugcugcucaucccggagcccgaccgccagcggacgccccaggacaaccagcuggccuacguggucaucgggcuccucuucaugauccugaccguggccgccaacgagaugggccugcucgagaccacgaagaaggaccuggggaucggcuacgcggccgccgagaaccaccagcacgccaccaugcuggacguggaccuccgcccggccuccgcguggacccuguacgccgucgccaccacggugaucacccccaugaugcggcacaccaucgagaacaccacggccaacaucagccugaccgccaucgcgaaccaggccgccauccucaugggccuggacaagggguggcccaucuccaagauggacaucggcgugccccugcucgcccuggggugcuacagccaggucaacccgcugacccucaccgcggccgugcugaugcugguggcccacuacgccaucaucggccccgggcuccaggccaaggcgacgcgcgaggcccagaagcgcaccgccgccggcaucaugaagaaccccaccgucgacggcaucguggccaucgaccuggaccccguggucuacgacgcgaaguucgagaagcagcuggggcagaucaugcuccugauccugugcaccucccagauccuccugaugcggacgaccugggcccugugcgagagcaucacccucgccaccggcccgcugacgacccugugggaggggucccccggcaaguucuggaacaccaccaucgccgugagcauggccaacaucuuccgcggcuccuaccucgcgggggccggccuggccuucagccugaugaagucccucgggggcgggcggcgcggcacgggcgcccagggggagacccugggcgagaaguggaagcggcagcugaaccagcucagcaaguccgaguucaacaccuacaagcgcagcgggaucauggagguggaccggagcgaggcgaaggagggccugaagcgcggggagaccacgaagcacgccgucucccggggcaccgccaagcugcgcugguucguggagcggaaccuggugaagcccgagggcaaggucaucgaccucgggugcggccgcgggggcuggagcuacuacugcgccgggcugaagaaggugaccgaggugaagggcuacaccaagggcgggcccggccacgaggagccgauccccauggccaccuacggguggaaccuggucaagcuccacuccggcaaggacguguucuucaugccgcccgagaagugcgacacgcugcugugcgacaucggggagagcuccccgaaccccaccaucgaggagggccggacccuccgcgugcugaagauggucgagcccuggcugcggggcaaccaguucugcaucaagauccucaaccccuacaugccgagcgugguggagacccuggagcagaugcagcgcaagcacgggggcaugcugguccggaacccccucucccgcaacagcacgcacgagauguacuggguguccugcgggaccggcaacaucgugagcgcggucaacaugaccucccggaugcugcugaaccgcuucaccauggcccaccgcaagcccacguacgagcgggacguggaccucggcgccgggacccgccacguggccgucgagcccgaggugccgaaccuggacaucaucggccagcggaucgagaacaucaagaacgagcacaagagcaccuggcacuacgacgaggacaaccccuacaagaccugggccuaccacggguccuacgaggugaagcccagcggcuccgcgagcuccauggucaacggggugguccgccugcucacgaagcccugggacgugaucccgauggugacccagaucgccaugaccgacaccacgcccuucggccagcagcgggucuucaaggagaagguggacacccgcacgccccgggccaagcgcggcaccacgcagaucauggaggugaccgccaaguggcuguggggguuccugagccggaacaagaagccgcgcaucugcacccgggaggaguucacccgcaagguccgguccaacgccgcgaucggcgccguguucguggacgagaaccaguggaacagcgccaaggaggccgucgaggacgagcgcuucugggaccucgugcaccgggagcgcgagcugcacaagcaggggaagugcgcgacgugcguguacaacaugaugggcaagcgggagaagaagcugggggaguucggcaaggccaagggcagccgcgccaucugguacauguggcucggggcccgguuccuggaguucgaggcccugggcuucaugaacgaggaccacugguucucccgcgagaacagccucuccggggucgagggcgaggggcugcacaagcugggcuacauccuccgggacaucagcaagauccccggcgggaacauguacgcggacgacaccgccggcugggacacccgcaucaccgaggacgaccugcagaacgaggccaagaucacggacaucauggagcccgagcacgcccugcucgccaccuccaucuucaagcugaccuaccagaacaagguggugcgcguccagcggcccgcgaagaacgggaccgugauggacgugaucagccgccgggaccagcgcggcuccggccaggucgggacguacggccugaacaccuucaccaacauggaggugcagcucauccggcagauggagagcgaggggaucuuccugccguccgagcuggagacccccaaccucgccgagcgcgugcuggacuggcuggagaagcacggcgccgagcggcucaagcgcauggccaucagcggggacgacugcgucgugaagcccaucgacgaccgguucgccacggcgcugaccgcccugaacgacaugggcaaggugcgcaaggacaucccccagugggagccguccaagggcuggaacgacuggcagcagguccccuucugcagccaccacuuccaccagcucaucaugaaggacgggcgggagaucguggugcccugccgcaaccaggacgagcuggucggccgggcccgcgugucccagggggccggcuggagccugcgggagaccgccugccucgggaaguccuacgcgcagauguggcagcugauguacuuccaccgccgggaccugcgccucgccgccaacgccaucugcagcgcggugcccgucgagugggugccgaccucccggaccacguggagcauccacgcccaccaccaguggaugaccaccgaggacaugcugagcguguggaaccgcgucuggaucgaggagaaccccuggauggaggacaagacccacguguccagcugggaggaggugcccuaccugggcaagcgcgaggaccaguggugcggcucccucaucgggcugacggcccgggccaccugggccaccaacauccaggucgcgaucaaccaggugcgccggcugaucggcaacgagaacuaccucgacuacaugaccagcaugaagcgcuucaagaacgaguccgaccccgagggggcccugugguga

SEQ ID NO: 7976 - RNA, 9879 nt, Artificial Sequence
  derived and/or modified CDS sequence (opt1) from DENV-1__GQ868564__SS-prME
agcgugaccaugcugcucaugcugcugcccaccgcccucgccuuccaccugaccacccggggcggggagccccacaugaucgugagcaagcaggagcggggcaaggcgcugcuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcucccagaccggcgagcaccggcgcgacaagcggagcguggcgcuggcgccccacgugggccuggggcucgagacccgcaccgagaccuggauguccagcgagggcgccuggaagcagauccagcgggucgagaccugggcccugcgccaccccggguucacggugaucgcccuguuccucgcccacgccaucggcaccuccaucacccagaaggggaucaucuucauccugcugaugcucgugacccccagcauggccaugcggugcgucggcaucggcaaccgcgacuucguggaggggcuguccggcgccacguggguggacgucgugcuggagcacgggagcugcgugaccaccauggcgaagaacaagcccacccucgacaucgagcugcugaagacggaggucaccaaccccgccgugcuccggaagcugugcaucgaggccaagaucuccaacaccaccacggacagccgcugcccgacccagggcgaggccacccugguggaggagcaggacgccaacuucgucugccggcgcaccuucguggaccggggcugggggaacggcugcggccucuucggcaaggggucccugcugacgugcgcgaaguucaagugcgugaccaagcucgagggcaagaucguccaguacgagaaccugaaguacagcgugaucgugaccguccacaccggcgaccagcaccagguggggaacgagacgaccgagcacggcaccaucgccaccaucacgccccaggcccccacguccgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccagcggggccuccaccagccaggagaccuggaaccggcaggaccuccuggugacguucaagaccgcgcacgccaagaagcaggaggucguggugcugggcagccaggagggcgccaugcacaccgcccucaccggggccacggagauccagaccuccggcaccaccacgaucuucgcggggcaccugaagugccgccugaagauggacaagcucacccugaagggcaugagcuacgucaugugcaccggguccuucaagcuggagaaggagguggccgagacccagcacggcacggugcugguccaggugaaguacgagggcaccgacgcccccugcaagauccccuucagcacccaggacgagaagggggugacccagaacggccggcucaucacggccaacccgaucgucaccgacaaggagaagcccgugaacaucgagaccgagccgcccuucggggaguccuacaucguggucggcgcgggcgagaaggcccugaagcugagcugguucaagaagggguccagcaucggcaagauguucgaggccaccgcccgcggggcccggcgcauggcgauccucggcgacacggccugggacuucggguccaucggcggcguguucaccagcguggggaagcugguccaccagguguucggcaccgccuacggggugcuguucuccggcgucagcuggaccaugaagaucgggaucggcauccuccugacguggcugggccucaacucccgcagcaccucccugagcaugaccugcaucgccguggggauggugacccuguaccucggcgucauggugcaggccgacuccgggugcgugaucaacuggaagggccgggagcugaagugcgggagcggcaucuucgucacgaacgaggugcacaccuggaccgagcaguacaaguuccaggcggacuccccgaagcgccugagcgccgccaucggcaaggccugggaggagggggugugcggcauccggagcgccacccgccucgagaacaucauguggaagcagaucuccaacgagcugaaccacauccugcucgagaacgacaugaaguucaccgucguggugggggacgcgaacggcauccuggcccaggggaagaagaugauccggccccagcccauggagcacaaguacagcuggaaguccuggggcaaggccaagaucaucggcgccgacauccagaacacgaccuucaucaucgacgggcccgacaccccggagugccccgacggccagcgcgcguggaacaucugggaggucgaggacuacggguucggcaucuucaccacgaacaucuggcugaagcuccgggacagcuacacccagaugugcgaccaccgccugauguccgccgccaucaaggacagcaaggccgugcacgccgacaugggcuacuggaucgaguccgagaagaacgagaccuggaagcuggcgcgggccagcuucaucgaggugaagaccugcacguggcccaagucccacacccucuggagcaacgggguccuggaguccgagaugaucauccccaagaucuacggcgggccgaucagccagcacaacuaccgccccggcuacuucacccagaccgccgggcccuggcaccugggcaagcucgagcuggacuucgaccugugcgagggcacgaccgugguggucgacgagcacugcgggaaccggggcccgucccuccgcaccaccacggugaccgggaagaucauccacgaguggugcugccggagcugcacccugccgccccugcgcuuccggggcgaggacgggugcugguacggcauggagauccgccccgugaaggagcgggaggagaaccucguccgcuccauggugagcgccggcuccggggagguggacagcuucagccugggcauccugugcgucuccaucaugaucgaggaggugaugcggagccgcuggucccgcaagaugcucaugaccgggacgcuggccguguuccugcuccugaucaugggccagcugaccuggaacgaccucacccggcugugcaucauggucggggcgaacgccagcgaccgcaugggcaugggcaccacguaccuggcccucauggccaccuucaagaugcggccgauguucgccguggggcugcuguuccgccggcucaccucccgcgaggugcugcugcucaccaucggccugagccuggucgcguccguggagcuccccaacagccuggaggagcugggggacggccucgccaugggcaucaugaugcugaagcugcucacggaguuccagccccaccagcuguggaccacccugcucucccugaccuucgucaagacgacccugagccucgacuacgccuggaagaccaccgccauggugcuguccaucgugagccuguucccccucugccuguccacgaccagccagaagaccaccuggcugccgguccuccugggguccuucggcugcaagccccugaccauguuccucaucacggagaacaagaucugggggcgcaagagcuggccccugaacgagggcaucauggcgaucgggaucguguccauccugcucagcucccugcugaagaacgacgugccccucgccggcccgcugaucgccggcgggaugcugaucgccugcuacgucaucagcggcagcuccgccgaccucagccuggagaaggcggccgagguguccugggagcacgaggccgagcacagcggggccucccacaacauccugguggagguccaggacgacggcaccaugaagaucaaggacgaggagcgcgacgacacccucaccauccugcugaaggccgcgcuccuggccgugagcgggguguaccccauguccauccccgccacgcuguucgucugguacuucuggcagaagaagaagcagcggagcggcgugcucugggacacccccuccccgcccgagguggagcgcgccguccuggacgacggcaucuaccggauccugcagcgcgggcugcucggccggagccaggugggggugggcgucuuccaggacgggguguuccacaccauguggcacgugacccgcggcgccguccugauguaccagggcaagcggcuggagcccuccugggcgagcgugaagaaggaccucaucuccuacgggggcggguggcgcuuccagggcagcuggaacacgggggaggaggugcaggucaucgccguggagcccggcaagaacccgaagaacgugcagaccacccccggcaccuucaagacgcccgagggggaggucggcgccaucgcccuggacuucaagcccgggaccuccggcagcccgaucgugaaccgggagggcaagaucguggggcuguacggcaacggggucgugaccaccuccggcacguacgugagcgccaucgcgcaggccaaggccucccaggaggggccccuccccgagaucgaggacgaggucuucaagaagcgcaaccugaccaucauggaccugcacccgggcagcggcaagacccggcgcuaccuccccgccaucgugcgggaggcgaucaagcgcaagcugcgcacccugauccucgcccccacgcggguggucgccagcgagauggccgaggcccugaaggggaugcccauccgcuaccagaccaccgcggugaaguccgagcacaccggccgggagaucguggaccugaugugccacgccacguucaccaugcgccuccugagcccgguccgggugcccaacuacaacaugaucaucauggacgaggcccacuucaccgaccccgccuccaucgccgcgcgcggguacaucagcacccgggugggcaugggggaggccgccgccaucuucaugacggccacgccgcccggcuccgucgaggcguucccccagagcaacgccgugauccaggacgaggagcgcgacauccccgagcgguccuggaacagcggcuacgacuggaucaccgacuuccccgggaagaccgugugguucguccccuccaucaagagcggcaacgacaucgccaacugccugcgcaagaacgggaagcgggugauccagcucucccgcaagacguucgacaccgaguaccagaagaccaagaacaacgacugggacuacguggucaccacggacaucagcgagaugggcgccaacuuccgggcggaccgcgugaucgacccccggcgcugccugaagcccgugauccugaaggacgggcccgagcgggucauccucgccggcccgaugcccgugaccgucgccuccgccgcccagcgccggggccgcaucgggcgcaaccagaacaaggagggcgaccaguacguguacauggggcagccccugaacaacgacgaggaccacgcgcacuggaccgaggccaagaugcugcucgacaacaucaacacccccgagggcaucaucccggcccuguucgagcccgagcgggagaaguccgccgccaucgacggggaguaccgccugcggggcgaggcgcgcaagacguucguggagcucaugcggcgcggcgaccugcccgucuggcuguccuacaagguggccagcgagggguuccaguacuccgaccggcgcuggugcuucgacggcgagcggaacaaccaggugcucgaggagaacauggacgucgagaucuggaccaaggagggggagcgcaagaagcugcggccccgcuggcuggacgcccggaccuacagcgacccgcucgcccugcgcgaguucaaggaguucgccgcgggccggcgcuccgugagcggcgaccugauccucgagaucgggaagcugccccagcaccugacccuccgggcccagaacgcccuggacaaccuggugaugcuccacaacagcgagcagggcgggaaggccuaccgccacgcgauggaggagcugcccgacaccaucgagacgcugaugcuccuggcccugaucgccguccucaccggcggggugacccuguucuuccuguccggcaagggccucgggaagaccagcaucggccugcugugcgugacggccuccagcgcccuccuguggauggcguccgucgagccccacuggaucgccgccagcaucauccuggaguucuuccucauggugcugcugaucccggagcccgaccggcagcgcacgccccaggacaaccagcucgccuacguggucaucgggcugcuguucaugauccucaccguggccgcgaacgagaugggccugcuggagaccacgaagaaggaccucgggaucggccacguggccgccgagaaccaccagcacgccaccaugcuggacgucgaccugcggccggccuccgcguggacccucuacgccguggccaccacggugaucacccccaugaugcgccacaccaucgagaacaccacggccaacaucagccugaccgccaucgcgaaccaggccgccauccugaugggccucgacaagggguggcccaucuccaagauggacaucggcgucccccugcuggcccucgggugcuacagccaggugaacccgcugacccugaccgcggccgugcucaugcuggucgcccacuacgccaucaucggccccgggcugcaggccaaggcgacgcgcgaggcccagaagcggaccgccgccggcaucaugaagaaccccaccguggacggcaucguggccaucgaccucgaccccgucguguacgacgcgaaguucgagaagcagcuggggcagaucaugcugcucauccugugcaccucccagauccugcucaugcgcacgaccugggcccugugcgagagcaucacccuggccaccggcccgcucacgacccugugggaggggucccccggcaaguucuggaacaccaccaucgccgugagcauggccaacaucuuccggggcuccuaccuggcgggggccggccucgccuucagccugaugaagucccucgggggcgggcgccgggggacgggcgcccagggggagacccucggcgagaaguggaagcgccagcugaaccagcugagcaaguccgaguucaacaccuacaagcggagcgggaucauggaggucgaccgcagcgaggcgaaggagggccucaagcgcggggagaccacgaagcacgccgugucccgcggcaccgccaagcugcggugguucguggagcgcaaccuggucaagcccgagggcaaggugaucgaccuggggugcggccgcgggggcuggagcuacuacugcgccgggcucaagaaggugaccgaggucaagggcuacaccaagggcgggcccggccacgaggagccgauccccauggccaccuacggguggaaccuggugaagcugcacuccggcaaggacguguucuucaugccgcccgagaagugcgacacgcuccugugcgacaucggggagagcuccccgaaccccaccaucgaggagggccgcacccugcggguccucaagaugguggagcccuggcugcgcggcaaccaguucugcaucaagauccugaaccccuacaugccgagcguggucgagacccucgagcagaugcagcggaagcacgggggcaugcuggugcgcaacccccugucccggaacagcacgcacgagauguacuggguguccugcgggaccggcaacaucgucagcgcggugaacaugaccucccgcaugcuccugaaccgcuucaccauggcccaccggaagcccacguacgagcgcgacguggaccugggcgccgggacccggcacgucgccguggagcccgagguggccaaccucgacaucaucggccagcgcaucgagaacaucaagaacgagcacaagagcaccuggcacuacgacgaggacaacccguacaagaccugggcguaccacggguccuacgaggucaagcccagcggcuccgccagcuccauggugaacggggucgugcggcugcugacgaagcccugggacgugauccccauggucacccagaucgccaugaccgacaccacgccguucggccagcagcgcguguucaaggagaagguggacacccggacgccccgggccaagcggggcaccacgcagaucauggaggucaccgccaaguggcucuggggguuccugagccgcaacaagaagccccggaucugcacccgcgaggaguucacccggaaggugcgcuccaacgcggccaucggcgccguguucgucgacgagaaccaguggaacagcgccaaggaggcgguggaggacgagcgguucugggaccuggugcaccgcgagcgggagcuccacaagcaggggaagugcgccacgugcgucuacaacaugaugggcaagcgcgagaagaagcugggggaguucggcaaggccaagggcagccgggccaucugguacauguggcugggggcccgcuuccucgaguucgaggcgcugggcuucaugaacgaggaccacugguucucccgggagaacagccuguccgggguggagggcgaggggcuccacaagcugggcuacauccugcgcgacaucagcaagaucccgggcgggaacauguacgccgacgacaccgccggcugggacacccgcaucaccgaggacgaccuccagaacgaggccaagaucacggacaucauggagcccgagcacgcccugcuggcgaccuccaucuucaagcucaccuaccagaacaaggugguccgggugcagcgccccgccaagaacgggaccgugauggacgucaucagccggcgcgaccagcggggcuccggccagguggggacguacggccugaacaccuucaccaacauggaggugcagcugauccgccagauggagagcgaggggaucuuccuccccuccgagcuggagaccccgaaccuggccgagcggguccucgacuggcuggagaagcacggcgccgagcgccugaagcggauggccaucagcggggacgacugcguggugaagcccaucgacgaccgcuucgcgacggcccucaccgcccugaacgacaugggcaagguccggaaggacaucccccagugggagcccuccaagggcuggaacgacuggcagcaggucccguucugcagccaccacuuccaccagcugaucaugaaggacgggcgcgagaucgugguccccugccggaaccaggacgagcucgugggccgcgcccgggugucccagggggccggcuggagccugcgcgagaccgcgugccuggggaaguccuacgcccagauguggcagcucauguacuuccaccggcgcgaccugcggcuggccgccaacgcgaucugcagcgccguccccguggagugggugcccaccucccgcaccacguggagcauccacgcccaccaccaguggaugaccaccgaggacaugcucagcgucuggaaccgcguguggaucgaggagaacccguggauggaggacaagacccacguguccagcugggaggagguccccuaccugggcaagcgggaggaccaguggugcggcucccugaucgggcucacggcccgcgccaccugggcgaccaacauccagguggccaucaaccaggugcggcgccugaucggcaacgagaacuaccuggacuacaugaccagcaugaagcgguucaagaacgaguccgaccccgagggggcccucugguga

SEQ ID NO: 7977 - RNA, 9879 nt, Artificial Sequence
  derived and/or modified CDS sequence (opt1) from DENV-1__GQ868565__SS-prME
agcgugaccaugcugcucaugcugcugcccaccgcccucgccuuccaccugaccacccgcggcggggagccccacaugaucgucagcaagcaggagcggggcaagagccuccuguucaagaccagcgcgggggugaacaugugcacccugaucgccauggaccugggcgagcucugcgaggacaccaugaccuacaagugcccccgcaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucaccaaccccgcggugcuccggaagcugugcaucgaggccaagaucagcaacaccaccacggacucccgcugcccgacccagggcgaggccacccugguggaggagcaggacgccaacuucgucugccggcgcaccuucguggaccggggcugggggaacggcugcggccuguucggcaaggggagccugcugacgugcgccaaguucaagugcgugaccaagcucgagggcaagaucguccaguacgagaaccugaaguacuccgugaucgugaccguccacaccggcgaccagcaccagguggggaacgagacgaccgagcacggcaccaucgcgaccaucacgccccaggcccccacgagcgagauccagcugaccgacuacggggcccucacccuggacugcagcccccgcaccggccuggacuucaacgagaugguccuccugacgaugaaggagaaguccuggcuggugcacaagcagugguuccucgaccugccgcugcccuggaccuccggggccagcaccagccaggagaccuggaaccggcaggaccuccuggugacguucaagaccgcccacgcgaagaagcaggaggucguggugcugggcucccaggagggcgccaugcacaccgcccucaccggggccacggagauccagaccagcggcaccaccacgaucuucgccgggcaccugaagugccgccugaagauggacaagcucacccugaagggcauguccuacgucaugugcaccgggagcuucaagcuggagaaggagguggcggagacccagcacggcacggugcugguccaggugaaguacgagggcaccgacgcccccugcaagauccccuucuccacccaggacgagaagggggugacccagaacggccggcucaucacggccaacccgaucgucaccgacaaggagaagcccgugaacaucgagaccgagccgcccuucggggagagcuacaucguggucggcgccggcgagaaggcgcugaagcuguccugguucaagaaggggagcuccaucggcaagauguucgaggccaccgcccgcggggcccggcgcauggccauccucggcgacacggcgugggacuucgggagcaucggcggcguguucaccuccguggggaagcugguccaccagguguucggcaccgccuacggggugcuguucagcggcgucuccuggaccaugaagaucgggaucggcauccuccugacguggcugggccucaacagccgcuccaccagccuguccaugaccugcaucgccguggggauggugacccuguaccucggcgucauggugcaggccgacagcgggugcgugaucaacuggaagggccgggagcugaagugcggguccggcaucuucgucacgaacgaggugcacaccuggaccgagcaguacaaguuccaggccgacagcccgaagcgccugagcgcggccaucggcaaggccugggaggagggggugugcggcauccgguccgccacccgccucgagaacaucauguggaagcagaucagcaacgagcugaaccacauccugcucgagaacgacaugaaguucaccgucguggugggggacgccaacggcauccuggcgcaggggaagaagaugauccggccccagcccauggagcacaaguacuccuggaaguccuggggcaaggccaagaucaucggcgccgacauccagaacgccacguucaucaucgacgggcccgacaccccggagugccccgacggccagcgcgcguggaacaucugggaggucgaggacuacggguucggcaucuucaccaccaacaucuggcugaagcuccgggacuccuacacgcagaugugcgaccaccgccugaugagcgccgccaucaaggacuccaaggccgugcacgccgacaugggcuacuggaucgagagcgagaagaacgagaccuggaagcuggcgcgggccuccuucaucgaggugaagaccugcaccuggcccaagagccacacgcucugguccaacgggguccuggagagcgagaugaucauccccaagaucuacggcgggccgaucucccagcacaacuaccgccccggcuacuucacccagaccgccgggcccuggcaccugggcaagcucgagcuggacuucgaccugugcgagggcaccacggugguggucgacgagcacugcgggaaccggggcccgagccuccgcaccaccaccgugacggggaagaucauccacgaguggugcugccgguccugcacccugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacccuggccguguuccugcuccugaucaugggccagcugacguggaacgaccucacccgccugugcaucauggucggggcgaacgccuccgaccggaugggcaugggcaccaccuaccuggcccucauggccacguucaagaugcgcccgauguucgccguggggcugcuguuccggcgccucaccagccgggaggugcugcugcucaccaucgggcugucccuggucgcgagcguggagcuccccaacucccuggaggagcugggggacggccucgccaugggcaucaugaugcugaagcugcucaccgaguuccagccccaccagcuguggacgacccugcucagccugaccuucgucaagaccacgcugucccucgacuacgccuggaagaccaccgccauggugcugagcaucgugucccuguucccccucugccugagcaccacgucccagaagaccaccuggcugccgguccuccuggggagcuucggcugcaagccccugaccauguuccucaucaccgagaacaagaucugggggcgcaaguccuggccccugaacgagggcaucauggcgaucgggaucgugagcauccugcucuccagccugcugaagaacgacgugccccucgccggcccgcugaucgccggcgggaugcugaucgccugcuacgucaucagcggcuccagcgccgaccucucccuggagaaggcggccgaggugagcugggagcaggaggccgagcacuccggggccagccacaacauccugguggagguccaggacgacggcacgaugaagaucaaggacgaggagcgggacgacacccucaccauccugcugaaggccacccuccuggcgguguccgggguguaccccaugagcauccccgccacgcuguucgucugguacuucuggcagaagaagaagcagcgcuccggcgugcucugggacacccccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggccuccgugaagaaggaccucaucagcuacgggggcggguggcgguuccagggccuguggaacacgggggaggaggugcaggucaucgcgguggagcccggcaagaacccgaagaacgugcagaccacccccggcaccuucaagacgcccgagggggaggucggcgccaucgcccuggacuucaagcccgggaccuccggcagcccgaucgugaaccgcgagggcaagaucguggggcucuacggcaacggggucgugaccaccuccggcacguacgugagcgccaucgcccaggcgaaggccucccaggaggggccccugcccgagaucgaggacgaggucuucaagaagcggaaccugaccaucauggaccuccacccgggcagcggcaagacccgccgguaccugcccgccaucgugcgcgaggccaucaagcggaagcugcgcacccucauccuggcgcccacgcgcguggucgccagcgagauggccgaggcccugaaggggaugcccauccgguaccagaccaccgccgugaaguccgagcacaccggccgcgagaucguggaccucaugugccacgcgacguucaccaugcggcugcugagcccgguccgcgugcccaacuacaacaugaucaucauggacgaggcccacuucaccgaccccgccuccaucgccgcccggggguacaucagcacccgcgugggcaugggggaggcggccgccaucuucaugacggccacgccgcccggcuccgucgaggccuucccccagagcaacgcggugauccaggacgaggagcgggacauccccgagcgcuccuggaacagcggcuacgacuggaucaccgacuuccccgggaagaccgugugguucguccccuccaucaagagcggcaacgacaucgccaacugccuccggaagaacgggaagcgcgugauccagcugucccggaagacguucgacaccgaguaccagaagaccaagaacaacgacugggacuacguggucaccacggacaucagcgagaugggcgccaacuuccgcgccgaccgggugaucgacccccgccggugccugaagcccgugauccucaaggacgggcccgagcgcgucauccuggcgggcccgaugcccgugaccgucgccuccgccgcccagcggcgcggccggaucgggcgcaaccagaacaaggagggcgaccaguacguguacauggggcagccccugaacaacgacgaggaccacgcccacuggaccgaggcgaagaugcuccuggacaacaucaacacccccgagggcaucaucccggcccuguucgagcccgagcgcgagaaguccgccgccaucgacggggaguaccggcuccgcggcgaggcccggaagacguucguggagcugaugcgccggggcgaccugcccgucuggcucuccuacaagguggcgagcgagggguuccaguacuccgaccgccgguggugcuucgacggcgagcgcaacaaccaggugcuggaggagaacauggacgucgagaucuggaccaaggagggggagcggaagaagcugcgcccccgguggcucgacgcccgcaccuacagcgacccgcuggcccugcgggaguucaaggaguucgccgccggccgccgguccgugagcggcgaccucauccuggagaucgggaagcugccccagcaccucacccugcgcgcgcagaacgcccuggacaaccucgugaugcugcacaacagcgagcagggcgggaaggccuaccggcacgccauggaggagcugcccgacaccaucgagacgcucaugcugcuggcgcucaucgccguccugaccggcggggugacccuguucuuccucuccggcaagggccuggggaagaccagcaucggccugcucugcgugacggccuccagcgcccugcuguggauggccuccgucgagccccacuggaucgcggccagcaucauccucgaguucuuccugauggugcugcucaucccggagcccgaccgccagcggacgccccaggacaaccagcuggccuacguggucaucgggcuccucuucaugauccugaccguggccgccaacgagaugggccugcucgagaccacgaagaaggaccuggggaucggcuacgcggccgccgagaaccaccagcacgccaccaugcuggacguggaccuccgcccggccuccgcguggacccuguacgccgucgccaccacggugaucacccccaugaugcggcacaccaucgagaacaccacggccaacaucagccugaccgccaucgcgaaccaggccgccauccucaugggccuggacaagggguggcccaucuccaagauggacaucggcgugccccugcucgcccuggggugcuacagccaggucaacccgcugacccucaccgcggccgugcugaugcugguggcccacuacgccaucaucggccccgggcuccaggccaaggcgacgcgcgaggcccagaagcgcaccgccgccggcaucaugaagaaccccaccgucgacggcaucguggccaucgaccuggaccccguggucuacgacgcgaaguucgagaagcagcuggggcagaucaugcuccugauccugugcaccucccagauccuccugaugcggacgaccugggcccugugcgagagcaucacccucgccaccggcccgcugacgacccugugggaggggucccccggcaaguucuggaacaccaccaucgccgugagcauggccaacaucuuccgcggcuccuaccucgcgggggccggccuggccuucagccugaugaagucccucgggggcgggcggcgcggcacgggcgcccagggggagacccugggcgagaaguggaagcggcagcugaaccagcucagcaaguccgaguucaacaccuacaagcgcagcgggaucauggagguggaccggagcgaggcgaaggagggccugaagcgcggggagaccacgaagcacgccgucucccggggcaccgccaagcugcgcugguucguggagcggaaccuggugaagcccgagggcaaggucaucgaccucgggugcggccgcgggggcuggagcuacuacugcgccgggcugaagaaggugaccgaggugaagggcuacaccaagggcgggcccggccacgaggagccgauccccauggccaccuacggguggaaccuggucaagcuccacuccggcaaggacguguucuucaugccgcccgagaagugcgacacgcugcugugcgacaucggggagagcuccccgaaccccaccaucgaggagggccggacccuccgcgugcugaagauggucgagcccuggcugcggggcaaccaguucugcaucaagauccucaaccccuacaugccgagcgugguggagacccuggagcagaugcagcgcaagcacgggggcaugcugguccggaacccccucucccgcaacagcacgcacgagauguacuggguguccugcgggaccggcaacaucgugagcgcggucaacaugaccucccggaugcugcugaaccgcuucaccauggcccaccgcaagcccacguacgagcgggacguggaccucggcgccgggacccgccacguggccgucgagcccgagguggccaaccuggacaucaucggccagcggaucgagaacaucaagaacgagcacaagagcaccuggcacuacgacgaggacaacccguacaagaccugggcguaccacggguccuacgaggugaagcccagcggcuccgccagcuccauggucaacggggugguccgccugcucacgaagcccugggacgugauccccauggugacccagaucgccaugaccgacaccacgccguucggccagcagcgggucuucaaggagaagguggacacccgcacgccccgggccaagcgcggcaccacgcagaucauggaggugaccgccaaguggcuguggggguuccugagccggaacaagaagccccgcaucugcacccgggaggaguucacccgcaagguccgguccaacgcggccaucggcgccguguucguggacgagaaccaguggaacagcgccaaggaggcggucgaggacgagcgcuucugggaccucgugcaccgggagcgcgagcugcacaagcaggggaagugcgccacgugcguguacaacaugaugggcaagcgggagaagaagcugggggaguucggcaaggccaagggcagccgcgccaucugguacauguggcucggggcccgguuccuggaguucgaggcgcugggcuucaugaacgaggaccacugguucucccgcgagaacagccucuccggggucgagggcgaggggcugcacaagcugggcuacauccuccgggacaucagcaagaucccgggcgggaacauguacgccgacgacaccgccggcugggacacccgcaucaccgaggacgaccugcagaacgaggccaagaucacggacaucauggagcccgagcacgcccugcucgcgaccuccaucuucaagcugaccuaccagaacaagguggugcgcguccagcggcccgccaagaacgggaccgugauggacgugaucagccgccgggaccagcgcggcuccggccaggucgggacguacggccugaacaccuucaccaacauggaggugcagcucauccggcagauggagagcgaggggaucuuccugcccuccgagcuggagaccccgaaccucgccgagcgcgugcuggacuggcuggagaagcacggcgccgagcggcucaagcgcauggccaucagcggggacgacugcgucgugaagcccaucgacgaccgguucgcgacggcccugaccgcccugaacgacaugggcaaggugcgcaaggacaucccccagugggagcccuccaagggcuggaacgacuggcagcaggucccguucugcagccaccacuuccaccagcucaucaugaaggacgggcgggagaucguggugcccugccgcaaccaggacgagcuggucggccgggcccgcgugucccagggggccggcuggagccugcgggagaccgcgugccucgggaaguccuacgcccagauguggcagcugauguacuuccaccgccgggaccugcgccucgccgccaacgcgaucugcagcgccgugcccgucgagugggugcccaccucccggaccacguggagcauccacgcccaccaccaguggaugaccaccgaggacaugcugagcguguggaaccgcgucuggaucgaggagaacccguggauggaggacaagacccacguguccagcugggaggaggugcccuaccugggcaagcgcgaggaccaguggugcggcucccucaucgggcugacggcccgggccaccugggcgaccaacauccaggucgccaucaaccaggugcgccggcugaucggcaacgagaacuaccucgacuacaugaccagcaugaagcgcuucaagaacgaguccgaccccgagggggcccugugguga

SEQ ID NO: 7978 - RNA, 9879 nt, Artificial Sequence
  derived and/or modified CDS sequence (opt1) from DENV-1__GQ868568__SS-prME
agcgugaccaugcugcucaugcugcugcccaccgcccucgccuuccaccugaccacccgcggcggggagccccacaugaucgugagcaagcaggagcggggcaagagccugcuguucaagaccagcgccggggugaacaugugcacccugaucgccauggaccugggcgagcucugcgaggacaccaugaccuacaagugcccccgcaucaccgaggccgagcccgacgacguggacugcuggugcaacgccaccgacaccugggugaccuacgggaccugcagccagaccggcgagcaccggcgcgacaagcgguccguggcccuggcgccccacgugggccuggggcucgagacccgcaccgagaccuggaugagcuccgagggcgccuggaagcagauccagcgggucgagaccugggcccugcgccaccccggguucacggugaucgcccuguuccucgcgcacgugaucggcaccagcaucacccagaaggggaucaucuucauccugcugaugcucgucacccccuccauggccaugcggugcgugggcaucggcaaccgcgacuucguggaggggcugagcggcgccacgugggucgacguggugcuggagcacggguccugcgucaccaccauggccaagaacaagcccacccucgacaucgagcugcugaagacggaggugaccaaccccgccgugcuccggaagcugugcaucgaggcgaagaucagcaacaccaccacggacucccgcugcccgacccagggcgaggccacccuggucgaggagcaggacgccaacuucgugugccggcgcaccuucguggaccggggcugggggaacggcugcggccucuucggcaaggggagccugcugacgugcgccaaguucaagugcgucaccaagcucgagggcaagaucgugcaguacgagaaccugaaguacuccgugaucgucaccgugcacaccggcgaccagcaccaggucgggaacgagacgaccgagcacggcaccaucgccaccaucacgccccaggcgcccacgagcgagauccagcugaccgacuacggggcccucacccuggacugcagcccccgcaccggccuggacuucaacgagauggugcuccugacgaugaaggagaaguccuggcuggugcacaagcagugguuccucgaccugccgcugcccuggaccuccggggccagcaccagccaggagaccuggaaccggcaggaccuccuggucacguucaagaccgcccacgccaagaagcaggagguggugguccugggcucccaggagggcgcgaugcacaccgcccucaccggggccacggagauccagaccagcggcaccaccacgaucuucgccgggcaccugaagugccgccugaagauggacaagcucacccugaagggcauguccuacgugaugugcaccgggagcuucaagcuggagaaggagguggccgagacccagcacggcacgguccugguccaggugaaguacgagggcaccgacgcgcccugcaagauccccuucuccacccaggacgagaagggggucacccagaacggccggcucaucacggccaacccgaucgugaccgacaaggagaagcccgugaacaucgagaccgagccgcccuucggggagagcuacaucgucgugggcgccggcgagaaggcccugaagcuguccugguucaagaaggggagcuccaucggcaagauguucgaggcgaccgcccgcggggcccggcgcauggccauccucggcgacacggccugggacuucgggagcaucggcggcguguucaccuccgucgggaagcuggugcaccagguguucggcaccgcguacgggguccuguucagcggcguguccuggaucaugaagaucgggaucggcauccuccugaccuggcugggccucaacagccgcuccacgagccuguccaugaccugcaucgccguggggauggucacccuguaccucggcgugauggugcaggccgacagcgggugcgucaucaacuggaagggccgggagcugaagugcggguccggcaucuucgugaccaacgaggugcacacguggaccgagcaguacaaguuccaggccgacagcccgaagcgccugagcgccgcgaucggcaaggccugggaggagggggucugcggcauccgguccgccacccgccucgagaacaucauguggaagcagaucagcaacgagcugaaccacauccugcucgagaacgacaugaaguucaccgugguggucggggacgccaacggcauccuggcccaggggaagaagaugauccggccccagcccauggagcacaaguacuccuggaaguccuggggcaaggcgaagaucaucggcgccgacacccagaacacgaccuucaucaucgacgggcccgacaccccggagugccccgacggccagcgcgccuggaacaucugggagguggaggacuacggguucggcaucuucaccacgaacaucuggcugaagcuccgggacuccuacacccagaugugcgaccaccgccugaugagcgccgcgaucaaggacuccaaggccgugcacgccgacaugggcuacuggaucgagagcgagaagaacgagaccuggaagcuggcccgggccuccuucaucgaggucaagaccugcacguggcccaagagccacacccucugguccaacggggugcuggagagcgagaugaucauccccaagaucuacggcgggccgaucucccagcacaacuaccgccccggcuacuucacccagaccgcggggcccuggcaccugggcaagcucgagcuggacuucgaccugugcgagggcacgaccguggucguggacgagcacugcgggaaccggggcccgagccuccgcaccaccacggugaccgggaagaucauccacgaguggugcugccgguccugcacccugccgccccugcgcuuccggggcgaggacgggugcugguacggcauggagauccgccccgucaaggagaaggaggagaaccucgugcggagcaugguguccgccggcagcggggaggucgacagcuucucccugggcauccugugcgugagcaucaugaucgaggaggugaugcgcucccgguggagccgcaagaugcucaugaccgggacgcuggccgucuuccugcuccugaucaugggccagcugaccuggaacgaccucacccgccugugcaucauggugggggccaacgccuccgaccggaugggcaugggcaccacguaccuggcgcucauggccaccuucaagaugcgcccgauguucgccguggggcugcuguuccggcgccucaccagccgggagguccugcugcucaccaucgggcugucccugguggccagcgucgagcuccccaacucccuggaggagcugggggacggccucgccaugggcaucaugaugcugaagcugcucacggaguuccagccccaccagcuguggaccacccugcucagccugaccuucgugaagacgacccugucccucgacuacgcguggaagaccaccgccauggugcugagcaucgucucccuguucccccucugccugagcacgaccucccagaagaccaccuggcugccggugcuccuggggagcuucggcugcaagccccugaccauguuccucaucacggagaacaagaucugggggcgcaaguccuggccccugaacgagggcaucauggccaucgggaucgugagcauccugcucuccagccugcugaagaacgacgucccccucgccggcccgcugaucgcgggcgggaugcugaucgccugcuacgugaucagcggcuccagcgccgaccucucccuggagaaggccgccgaggugagcugggagcaggaggcggagcacuccggggccagccacaacauccuggucgaggugcaggacgacggcaccaugaagaucaaggacgaggagcgggacgacacccucaccauccugcugaaggccacgcuccuggccguguccggggucuaccccaugagcauccccgccacccuguucgugugguacuucuggcagaagaagaagcagcgcuccggcgugcucugggacacccccagcccgcccgaggucgagcgggcggugcuggacgacggcaucuaccgcauccugcagcgggggcugcucggccgcucccaggugggggucggcguguuccaggacgggguguuccacaccauguggcacgucacgcggggcgccgugcugauguaccagggcaagcgccuggagcccagcugggccuccgugaagaaggaccucaucagcuacgggggcggguggcgguuccagggcuccuggaacaccggggaggagguccaggugaucgccguggagcccggcaagaacccgaagaacguccagaccacccccggcacguucaagacccccgagggggaggugggcgccaucgcgcuggacuucaagcccgggaccagcggcuccccgaucgugaaccgcgagggcaagaucgucgggcuguacggcaacgggguggugaccacgagcggcaccuacgucuccgccaucgcccaggccaaggccagccaggaggggccccuccccgagaucgaggacgagguguucaagaagcggaaccugaccaucauggaccugcacccgggcagcggcaagacccgccgguaccuccccgcgaucgugcgcgaggccaucaagcggaagcugcgcacgcugauccucgcccccacccgcgucguggccuccgagauggcggaggcccugaaggggaugcccauccgguaccagaccaccgccgucaagagcgagcacacgggccgcgagaucgucgaccugaugugccacgccaccuucaccaugcggcuccuguccccggugcgcgugcccaacuacaacaugaucaucauggacgaggcccacuucaccgaccccgcgagcaucgccgcccggggguacaucuccacgcgcgucggcaugggggaggccgccgcgaucuucaugaccgccacgccgcccggcagcguggaggccuucccccaguccaacgccgugauccaggacgaggagcgggacauccccgagcgcagcuggaacuccggcuacgacuggaucaccgacuuccccgggaagacggucugguucgugcccagcaucaaguccggcaacgacaucgccaacugccugcggaagaacgggaagcgcgugauccagcucagccggaagaccuucgacaccgaguaccagaagaccaagaacaacgacugggacuacgucgugacgaccgacaucuccgagaugggcgcgaacuuccgcgccgaccgggugaucgacccccgccggugccugaagcccgucauccugaaggacgggcccgagcgcgugauccucgccggcccgaugcccgucaccguggccagcgcggcccagcggcgcggccggaucgggcgcaaccagaacaaggagggcgaccaguacguguacauggggcagccccugaacaacgacgaggaccacgcccacuggaccgaggccaagaugcugcucgacaacaucaacacgcccgagggcaucaucccggcccuguucgagcccgagcgcgagaaguccgcggccgucgacggggaguaccggcugcgcggcgaggcccggaagaccuucguggagcucaugcgccggggcgaccugcccguguggcugagcuacaaggucgccuccgagggguuccaguacagcgaccgccgguggugcuucgacggcgagcgcaacaaccaggugcucgaggagaacauggacguggagaucuggaccaaggagggggagcggaagaagcugcgcccccgguggcuggacgcccgcaccuacuccgacccgcucgcgcugcgggaguucaaggaguucgccgccggccgccggagcgucagcggcgaccugauccucgagaucgggaagcugccccagcaccugacccuccgcgcccagaacgcccuggacaaccuggugaugcuccacaacuccgagcagggcgggaaggcguaccggcacgccauggaggagcugcccgacacgaucgagacccugaugcuccuggcccugaucgccgugcucaccggcggggucacccuguucuuccugagcggcaagggccucgggaagacguccaucggccugcugugcgugaccgcgagcuccgcccuccuguggauggccagcguggagccccacuggaucgccgccuccaucauccuggaguucuuccucaugguccugcugaucccggagcccgaccgccagcggacgccccaggacaaccagcucgcguacguggugaucgggcugcuguucaugauccucaccgucgccgccaacgagaugggccugcuggagacgaccaagaaggaccucgggaucggcuacguggccgccgagaaccaccagcacgcgaccaugcuggacguggaccugcgcccggccagcgccuggacccucuacgccgucgccacgaccgugaucacccccaugaugcggcacaccaucgagaacacgaccgcgaacaucucccugaccgccaucgccaaccaggccgccauccugaugggccucgacaagggguggcccaucagcaagauggacaucggcgugccccugcuggcgcucgggugcuacucccaggucaacccgcugacccugacggccgccgugcucaugcugguggcccacuacgcgaucaucggccccgggcugcaggccaaggccacccgcgaggcccagaagcgcaccgccgcgggcaucaugaagaaccccaccgucgacggcaucguggccaucgaccucgaccccguggucuacgacgccaaguucgagaagcagcuggggcagaucaugcugcucauccugugcacgagccagauccugcucaugcggaccaccugggcccugugcgaguccaucacccuggccacgggcccgcucaccacccugugggaggggagccccggcaaguucuggaacaccacgaucgcgguguccauggccaacaucuuccgcggcagcuaccuggccggggccggccucgccuucucccugaugaagucccucgggggcgggcggcgcgggaccggcgcgcagggggagacccucggcgagaaguggaagcggcagcugaaccagcuguccaagagcgaguucaacaccuacaagcgcagcgggaucauggagguggaccgguccgaggccaaggagggccucaagcgcggggagacgaccaagcacgccgucagccggggcaccgccaagcugcgcugguucguggagcggaaccuggugaagcccgagggcaaggucaucgaccuggggugcggccgcgggggcugguccuacuacugcgcggggcucaagaaggugaccgaggugaagggcuacaccaagggcgggcccggccacgaggagccgauccccauggccacguacggguggaaccuggucaagcugcacagcggcaaggacguguucuucaugccgcccgagaagugcgacacccuccugugcgacaucggggaguccagcccgaaccccaccaucgaggagggccggacccugcgcgugcucaagauggucgagcccuggcugcggggcaaccaguucugcaucaagauccugaaccccuacaugccguccgugguggagacgcucgagcagaugcagcgcaagcacgggggcaugcugguccggaacccccugagccgcaacuccacccacgagauguacugggugagcugcgggaccggcaacaucguguccgccgucaacaugaccagccggaugcuccugaaccgcuucacgauggcccaccgcaagcccaccuacgagcgggacguggaccugggcgccgggacccgccacguggcggucgagcccgagguggccaaccucgacaucaucggccagcggaucgagaacaucaagaacgagcacaaguccaccuggcacuacgacgaggacaacccguacaagacgugggccuaccacgggagcuacgaggucaagcccuccggcagcgccuccagcauggugaacggggugguccgccugcugaccaagcccugggacgugauccccauggugacccagaucgccaugaccgacacgaccccguucggccagcagcgggucuucaaggagaagguggacacccgcacgccccgggcgaagcgcggcacgacccagaucauggaggugaccgccaaguggcucuggggguuccugucccggaacaagaagccccgcaucugcacccgggaggaguucacgcgcaagguccggagcaacgccgccaucggcgccguguucguggacgagaaccaguggaacagcgcgaaggaggccgucgaggacgagcgcuucugggaccuggugcaccgggagcgcgagcuccacaagcaggggaagugcgcgaccugcguguacaacaugaugggcaagcgggagaagaagcugggggaguucggcaaggccaagggcucccgcgcgaucugguacauguggcugggggcccgguuccucgaguucgaggcccugggcuucaugaacgaggaccacugguucagccgcgagaacucccugagcggggucgagggcgaggggcuccacaagcugggcuacauccugcgggacaucuccaagaucccgggcgggaacauguacgccgacgacaccgccggcugggacacccgcaucacggaggacgaccuccagaacgaggcgaagaucaccgacaucauggagcccgagcacgcccugcuggccaccagcaucuucaagcucaccuaccagaacaagguggugcgcguccagcggcccgccaagaacgggacggugauggacgugaucucccgccgggaccagcgcggcagcggccaggucgggaccuacggccugaacaccuucaccaacauggaggugcagcugauccggcagauggaguccgaggggaucuuccuccccagcgagcuggagacgccgaaccuggccgagcgcgugcucgacuggcuggagaagcacggcgcggagcggcugaagcgcauggccaucuccggggacgacugcgucgugaagcccaucgacgaccgguucgccaccgcccucaccgcccugaacgacaugggcaaggugcgcaaggacaucccccagugggagcccagcaagggcuggaacgacuggcagcaggucccguucugcucccaccacuuccaccagcugaucaugaaggacgggcgggagaucguggugcccugccgcaaccaggacgagcucgucggccgggcgcgcgugagccagggggccggcuggucccugcgggagaccgccugccugggcaagagcuacgcccagauguggcagcucauguacuuccaccgccgggaccugcgccuggccgcgaacgccaucugcuccgccgugcccgucgagugggugcccaccagccggacgaccuggagcauccacgcccaccaccaguggaugaccaccgaggacaugcucuccguguggaaccgcgucuggaucgaggagaacccguggauggaggacaagacgcacgugagcuccugggaggaggugcccuaccugggcaagcgcgaggaccaguggugcggcagccugaucgggcucaccgcgcgggccaccugggccaccaacauccaggucgccaucaaccaggugcgccggcugaucggcaacgagaacuaccuggacuacaugacguccaugaagcgcuucaagaacgagagcgaccccgagggggcccucugguga

SEQ ID NO: 7979 - RNA, 9879 nt, Artificial Sequence
  derived and/or modified CDS sequence (opt1) from DENV-1__GQ868569__SS-prME
agcgugaccaugcugcucaugcugcugcccaccgcccucgccuuccaccugaccacccgcggcggggagccccacaugaucgucagcaagcaggagcggggcaagagccuccuguucaagaccagcgccggggugaacaugugcacccugaucgccauggaccugggcgagcucugcgaggacaccaugaccuacaagugcccccggaucaccgaggccgagcccgacgacguggacugcuggugcaacgccaccgacaccugggucaccuacgggaccugcagccagaccggcgagcaccggcgcgacaagcgguccguggcccuggcgccccacgugggccuggggcucgagacgcgcaccgagaccuggaugagcuccgagggcgccuggaagcagauccagcgggucgagaccugggcccugcgccaccccggguucacggugaucgcccuguuccucgcgcacgccaucggcaccagcaucacccagaaggggaucaucuucauccugcugaugcucgugacccccuccauggccaugcggugcgucggcaucggcaaccgcgacuucguggaggggcugagcggcgccacguggguggacgucgugcuggagcacggguccugcgugaccaccauggccaagaacaagcccacccucgacaucgagcugcugaagacggaggucgcgaaccccgccgugcuccggaagcugugcaucgaggccaagaucagcaacaccaccaccgacucccgcugcccgacgcagggcgaggccacccugguggaggagcaggacgccaacuucgucugccggcgcaccuucguggaccggggcugggggaacggcugcggccuguucggcaaggggagccugcugaccugcgcgaaguucaagugcgugacgaagcucgagggcaagaucguccaguacgagaaccugaaguacuccgugaucgugaccguccacaccggcgaccagcaccagguggggaacgagaccacggagcacggcaccaucgccaccaucacgccccaggcccccaccagcgagauccagcugacggacuacggggcccucacccuggacugcagcccccggaccggccuggacuucaacgagaugguccuccugaccaugaaggagaaguccuggcuggugcacaagcagugguuccucgaccugccgcugcccuggacguccggggccagcaccagccaggagaccuggaaccggcaggaccuccuggugaccuucaagacggcgcacgccaagaagcaggaggucguggugcugggcucccaggagggcgccaugcacaccgcccucaccggggccaccgagauccagacgagcggcaccaccaccaucuucgcggggcaccugaagugccgccugaagauggacaagcucacgcugaagggcauguccuacgucaugugcaccgggagcuucaagcuggagaaggagguggccgagacccagcacggcaccgugcugguccaggugaaguacgagggcacggacgcccccugcaagauccccuucuccacccaggacgagaagggggugacccagaacggccggcucaucaccgccaacccgaucgucacggacaaggagaagcccgugaacaucgagaccgagccgcccuucggggagagcuacaucguggucggcgcgggcgagaaggcccugaagcuguccugguucaagaaggggagcuccaucggcaagauguucgaggccaccgcccgcggggcccggcgcauggcgauccucggcgacaccgccugggacuucgggagcaucggcggcguguucacguccguggggaagcugguccaccagguguucggcaccgccuacggggugcuguucagcggcgucuccuggaccaugaagaucgggaucggcauccuccugaccuggcugggccucaacagccgcuccacgagccuguccaugaccugcaucgccguggggauggugacccuguaccucggcgucauggugcaggccgacagcgggugcgugaucaacuggaagggccgggagcugaagugcggguccggcaucuucgucaccaacgaggugcacacguggaccgagcaguacaaguuccaggcggacagcccgaagcgccugagcgccgccaucggcaaggccugggaggagggggugugcggcauccgguccgccacccgccucgagaacaucauguggaagcagaucagcaacgagcugaaccacauccugcucgagaacgacaugaaguucaccgucguggugggggacgcgaacggcauccuggcccaggggaagaagaugauccggccccagcccauggagcacaaguacuccuggaaguccuggggcaaggccaagaucaucggcgccgacauccagaacgcgaccuucaucaucgacgggcccgacacgccggagugccccgacggccagcgcgccuggaacaucugggaggucgaggacuacggguucggcaucuucaccaccaacaucuggcugaagcuccgggacuccuacacccagaugugcgaccaccgccugaugagcgccgccaucaaggacuccaaggccgugcacgcggacaugggcuacuggaucgagagcgagaagaacgagacguggaagcuggcccgggccuccuucaucgaggugaagaccugcaccuggcccaagagccacacccucugguccaacgggguccuggagagcgagaugaucauccccaagaucuacggcgggccgaucucccagcacaacuaccgccccggcuacuucacgcagaccgccgggcccuggcaccugggcaagcucgagcuggacuucgaccugugcgagggcaccaccgugguggucgacgagcacugcgggaaccggggcccgagccuccgcacgaccaccgugaccgggaagaucauccacgaguggugcugccgguccugcacgcugccgccccugcgcuuccggggcgaggacgggugcugguacggcauggagauccgccccgugaaggagaaggaggagaaccucguccggagcaugguguccgccggcagcggggagguggacagcuucucccugggcauccugugcgucagcaucaugaucgaggaggugaugcgcucccgguggagccgcaagaugcucaugaccgggacccuggcgguguuccugcuccugaucaugggccagcugaccuggaacgaccucacgcgccugugcaucauggucggggccaacgccuccgaccggaugggcaugggcaccaccuaccuggcccucauggccaccuucaagaugcgcccgauguucgcgguggggcugcuguuccggcgccucacgagccgggaggugcugcugcucaccaucggccugucccuggucgccagcguggagcuccccaacucccuggaggagcugggggacggccucgccaugggcaucaugaugcugaagcugcucaccgaguuccagccccaccagcuguggaccacgcugcucagccugaccuucgucaagaccacccugucccucgacuacgccuggaagacgaccgcgauggugcugagcaucgugucccuguucccccucugccugagcaccaccucccagaagacgaccuggcugccgguccuccuggggagcuucggcugcaagccccugaccauguuccucaucaccgagaacaagaucugggggcgcaaguccuggccccugaacgagggcaucauggccaucgggaucgugagcauccugcucuccagccugcugaagaacgacgugccccucgccggcccgcugaucgccggcgggaugcugaucgccugcuacgucaucagcggcuccagcgcggaccucucccuggagaaggccgccgaggugagcugggagcaggaggccgagcacuccggggccagccacaacauccugguggagguccaggacgacggcaccaugaagaucaaggacgaggagcgggacgacacgcucaccauccugcugaaggcgacccuccuggccguguccgggguguaccccaugagcauccccgccacccuguucgucugguacuucuggcagaagaagaagcagcgcuccggcgugcucugggacacgcccagcccgcccgagguggagcgggccguccuggacgacggcaucuaccgcauccugcagcgggggcugcucggccgcucccaggugggggugggcgucuuccaggacgggguguuccacaccauguggcacgugacccggggcgccguccugauguaccagggcaagcgccuggagcccagcugggcguccgugaagaaggaccucaucagcuacgggggcggguggcgguuccagggccuguggaacaugggggaggaggugcaggucaucgccguggagcccggcaagaacccgcgcaacgugcagaccacgcccggcaccuucaagacccccgagggggaggucggcgccaucgcccuggacuucaagcccgggaccuccggcagcccgaucgugaaccgggagggcaagaucguggggcucuacggcaacggggucgugacgaccuccggcaccuacgugagcgccaucgcgcaggccaaggccucccaggaggggccccugcccgagaucgaggacgaggucuucaagaagcgcaaccugaccaucauggaccuccacccgggcagcggcaagacgcggcgcuaccugcccgccaucgugcgggaggcgaucaagcgcaagcugcgcacccucauccuggcccccacccggguggucgccagcgagauggccgaggcccugaaggggaugcccauccgcuaccagaccacggcggugaaguccgagcacaccggccgggagaucguggaccucaugugccacgccaccuucaccaugcgccugcugagcccgguccgggugcccaacuacaacaugaucaucauggacgaggcccacuucacggaccccgccuccaucgccgcgcgcggguacaucagcacccgggugggcaugggggaggccgccgccaucuucaugaccgccacgccgcccggcuccgucgaggcguucccccagagcaacgccgugauccaggacgaggagcgcgacauccccgagcgguccuggaacagcggcuacgacuggaucacggacuuccccgggaagaccgugugguucguccccuccaucaagagcggcaacgacaucgccaacugccuccgcaagaacgggaagcgggugauccagcugucccgcaagaccuucgacaccgaguaccagaagacgaagaacaacgacugggacuacguggucaccaccgacaucagcgagaugggcgccaacuuccgggcggaccgcgugaucgacccccggcgcugccugaagcccgugauccucaaggacgggcccgagcgggucauccuggccggcccgaugcccgugaccgucgccuccgccgcccagcgccggggccgcaucgggcgcaaccagaacaaggagggcgaccaguacguguacauggggcagccccugaacaacgacgaggaccacgcgcacuggacggaggccaagaugcuccuggacaacaucaacacccccgagggcaucaucccggcccuguucgagcccgagcgggagaaguccgccgccaucgacggggaguaccgccuccggggcgaggcgcgcaagaccuucguggagcugaugcggcgcggcgaccugcccgucuggcucuccuacaagguggccagcgagggguuccaguacuccgaccggcgcuggugcuucgacggcgagcggaacaaccaggugcuggaggagaacauggacgucgagaucuggaccaaggagggggagcgcaagaagcugcggccccgcuggcucgacgcccggacguacagcgacccgcuggcccugcgcgaguucaaggaguucgccgcgggccggcgcuccgugagcggcgaccucauccuggagaucgggaagcugccccagcaccucacccugcgggcccagaacgcccuggacaaccucgugaugcugcacaacagcgagcagggcgggaaggccuaccgccacgcgauggaggagcugcccgacaccaucgagacccucaugcugcuggcccucaucgccguccugaccggcggggugacgcuguucuuccucuccggcaagggccuggggaagaccagcaucggccugcucugcgugaccgccuccagcgcccugcuguggauggcguccgucgagccccacuggaucgccgccagcaucauccucgaguucuuccugauggugcugcucaucccggagcccgaccggcagcgcacgccccaggacaaccagcuggccuacguggucaucgggcuccucuucaugauccugacgguggccgcgaacgagaugggccugcucgagaccaccaagaaggaccuggggaucggcuacgccgccgccgagaaccaccagcacgccaccaugcuggacguggaccuccggccggcguccgccuggacgcuguacgccgucgccaccaccgugaucacccccaugaugcgccacacgaucgagaacaccaccgccaacaucagccugaccgcgaucgccaaccaggccgccauccucaugggccuggacaagggguggcccaucuccaagauggacaucggcgugccccugcucgcgcuggggugcuacagccaggucaacccgcugacgcucaccgccgccgugcugaugcugguggcccacuacgccaucaucggccccgggcuccaggcgaaggccacccgcgaggcccagaagcggaccgccgccggcaucaugaagaaccccacggucgacggcaucguggcgaucgaccuggaccccguggucuacgacgccaaguucgagaagcagcuggggcagaucaugcuccugauccugugcaccucccagauccuccugaugcgcaccaccugggcccugugcgagagcaucacgcucgccaccggcccgcugaccacccugugggaggggucccccggcaaguucuggaacacgaccaucgccgugagcauggcgaacaucuuccggggcuccuaccucgccggggccggccuggccuucagccugaugaagucccucgggggcgggcgccggggcaccggcgcgcagggggagacccugggcgagaaguggaagcgccagcugaaccagcucagcaaguccgaguucaacacguacaagcggagcgggaucauggagguggaccgcagcgaggccaaggagggccugaagcgcggggagaccaccaagcacgccgucucccgcggcaccgccaagcugcggugguucguggagcgcaaccuggugaagcccgagggcaaggucaucgaccucgggugcggccgcggcggguggagcuacuacugcgccgggcugaagaaggugacggaggugaagggguacaccaagggcgggcccggccacgaggagccgauccccauggcgaccuacggguggaaccuggucaagcuccacuccggcaaggacguguucuucaugccgcccgagaagugcgacacccugcugugcgacaucggggagagcuccccgaaccccaccaucgaggagggccgcacgcuccgggugcugaagauggucgagcccuggcugcgcggcaaccaguucugcaucaagauccucaaccccuacaugccgagcgugguggagacccuggagcagaugcagcggaagcacgggggcaugcugguccgcaacccccucucccggaacagcacccacgagauguacuggguguccugcgggaccggcaacaucgugagcgccgucaacaugacgucccgcaugcugcugaaccgcuucaccauggcccaccggaagcccaccuacgagcgcgacguggaccucggcgccgggacccggcacguggccgucgagcccgagguggcgaaccuggacaucaucggccagcgcaucgagaacaucaagaacgagcacaagagcacguggcacuacgacgaggacaacccguacaagaccugggccuaccacggguccuacgaggugaagcccagcggcuccgccagcuccauggucaacggggugguccggcugcucaccaagcccugggacgugauccccauggugacccagaucgccaugacggacaccaccccguucggccagcagcgcgucuucaaggagaagguggacacccggacgccccgcgccaagcggggcaccacccagaucauggaggugaccgcgaaguggcuguggggguuccugagccgcaacaagaagccccggaucugcacgcgcgaggaguucacccggaagguccgcuccaacgccgccaucggcgccguguucguggacgagaaccaguggaacagcgcgaaggaggccgucgaggacgagcgguucugggaccucgugcaccgcgagcgggagcugcacaagcaggggaagugcgcgaccugcguguacaacaugaugggcaagcgcgagaagaagcugggggaguucggcaaggccaagggcagccgggccaucugguacauguggcucggggcgcgcuuccuggaguucgaggcccugggcuucaugaacgaggaccacugguucucccgggagaacagccucuccggggucgagggcgaggggcugcacaagcugggcuacauccuccgcgacaucagcaagaucccgggcgggaacauguacgccgacgacaccgccggcugggacacgcgcaucaccgaggacgaccugcagaacgaggccaagaucaccgacaucauggagcccgagcacgcgcugcucgccaccuccaucuucaagcugacguaccagaacaagguggugcggguccagcgccccgccaagaacgggaccgugauggacgugaucagccggcgcgaccagcggggcuccggccaggucgggaccuacggccugaacaccuucacgaacauggaggugcagcucauccgccagauggagagcgaggggaucuuccugcccuccgagcuggagaccccgaaccucgccgagcgggugcuggacuggcuggagaagcacggcgccgagcgccucaagcggauggcgaucagcggggacgacugcgucgugaagcccaucgacgaccgcuucgccaccgcccugaccgcccugaacgacaugggcaaggugcggaaggacaucccccagugggagcccuccaagggcuggaacgacuggcagcaggucccguucugcagccaccacuuccaccagcucaucaugaaggacgggcgcgagaucguggugcccugccggaaccaggacgagcuggucggccgcgcccgggugucccagggggcgggcuggagccugcgcgagacggccugccucgggaaguccuacgcccagauguggcagcugauguacuuccaccggcgcgaccugcggcucgccgcgaacgccaucugcagcgccgugcccgucgagugggugcccaccucccgcaccaccuggagcauccacgcccaccaccaguggaugaccacggaggacaugcugagcguguggaaccgcgucuggaucgaggagaacccguggauggaggacaagacccacguguccagcugggaggaggugcccuaccugggcaagcgggaggaccaguggugcggcucccucaucgggcugaccgcccgcgcgaccugggccacgaacauccaggucgccaucaaccaggugcggcgccugaucggcaacgagaacuaccucgacuacaugaccagcaugaagcgguucaagaacgaguccgaccccgagggggcccugugguga
